United States Patent
Green

(10) Patent No.: US 11,186,835 B2
(45) Date of Patent: Nov. 30, 2021

(54) ARTIFICIAL RIBOSOMES FOR FULLY PROGRAMMABLE SYNTHESIS OF NONRIBOSOMAL PEPTIDES

(71) Applicant: ARIZONA BOARD OF REGENTS ON BEHALF OF ARIZONA STATE UNIVERSITY, Scottsdale, AZ (US)

(72) Inventor: Alexander A. Green, Scottsdale, AZ (US)

(73) Assignee: Arizona Board of Regents on behalf of Arizona State University, Scottsdale, AZ (US)

(*) Notice: Subject to any disclaimer, the term of this patent is extended or adjusted under 35 U.S.C. 154(b) by 49 days.

(21) Appl. No.: 16/245,984

(22) Filed: Jan. 11, 2019

(65) Prior Publication Data

US 2019/0382746 A1    Dec. 19, 2019

Related U.S. Application Data

(60) Provisional application No. 62/616,061, filed on Jan. 11, 2018.

(51) Int. Cl.

| | | |
|---|---|---|
| C12N 9/00 | (2006.01) | |
| C12P 21/02 | (2006.01) | |
| C07K 14/005 | (2006.01) | |
| C07K 14/47 | (2006.01) | |
| C12N 15/113 | (2010.01) | |
| C12P 7/64 | (2006.01) | |

(52) U.S. Cl.
CPC .............. *C12N 9/93* (2013.01); *C07K 14/005* (2013.01); *C07K 14/47* (2013.01); *C12N 15/113* (2013.01); *C12P 7/6409* (2013.01); *C12P 21/02* (2013.01); *C12Y 603/02* (2013.01); *C07K 2319/00* (2013.01); *C12N 2740/10022* (2013.01); *C12N 2740/16022* (2013.01); *C12N 2740/16222* (2013.01); *C12N 2795/10322* (2013.01)

(58) Field of Classification Search
CPC .... C12N 9/93; C12N 15/113; C12N 2310/16; C12P 21/02; C12Y 603/02; C07K 2319/00
See application file for complete search history.

(56) References Cited

U.S. PATENT DOCUMENTS

| | | |
|---|---|---|
| 10,550,440 B2 | 2/2020 | Green |
| 2019/0185856 A1 | 6/2019 | Green |
| 2019/0218624 A1 | 7/2019 | Green |
| 2019/0256898 A1 | 8/2019 | Green |
| 2019/0276901 A1 | 9/2019 | Green |
| 2019/0285620 A1 | 9/2019 | Green |
| 2020/0071777 A1 | 3/2020 | Green |
| 2020/0080137 A1 | 3/2020 | Green |

FOREIGN PATENT DOCUMENTS

| | | |
|---|---|---|
| WO | 2017147585 A1 | 8/2017 |
| WO | 2017205668 A1 | 11/2017 |
| WO | 2018026762 A1 | 2/2018 |
| WO | 2018026765 A1 | 2/2018 |
| WO | 2018027177 A1 | 2/2018 |
| WO | 2018075502 A1 | 4/2018 |
| WO | 2018093898 A1 | 5/2018 |
| WO | 2018112350 A1 | 6/2018 |
| WO | 2018187687 A1 | 10/2018 |

OTHER PUBLICATIONS

Bahadur et al. (Biophys. J. 97(12):3139-3149, 2009) (Year: 2009).*
Sieber et al. (Chem. Rev. 2005, 105, 715-738) (Year: 2005).*
Miller and Gulick (Methods Mol Biol. 1401: 3-29, 2014) (Year: 2014).*
Sachdeva et al., Supporting information from Nucleic Acids Research 42(14): 9493-9503, 2014 (Year: 2014).*
Delebecque, Camille J., et al. "Organization of intracellular reactions with rationally designed RNA assemblies." Science 333.6041 (2011): 470-474.
Felnagle, E.A., et al. "Nonribosomal peptide synthetases involved in the production of medically relevant natural products." Molecular pharmaceutics 5.2 (2008): 191-211.
Grabow, Wade W., et al. "Self-assembling RNA nanorings based on RNAI/II inverse kissing complexes." Nano letters 11.2 (2011): 878-887.
Hahn, M., et al., "Harnessing the potential of communication-mediating domains for the biocombinatorial synthesis of nonribosomal peptides," Proc Natl Acad Sci U S A 103, 275-280 (2006).
Hahn, M., et al., "Selective interaction between nonribosomal peptide synthetases is facilitated by short communication-mediating domains," Proc Natl Acad Sci U S A 101, 15585-15590 (2004).
Kohli, R.M., et al. "Biomimetic synthesis and optimization of cyclic peptide antibiotics." Nature 418.6898 (2002): 658.
McQuade, Thomas J., et al. "A nonradioactive high-throughput assay for screening and characterization of adenylation domains for nonribosomal peptide combinatorial biosynthesis." Analytical biochemistry 386.2 (2009): 244-250.
Mootz, H.D. et al., "The tyrocidine biosynthesis operon of Bacillus brevis: complete nucleotide sequence and biochemical characterization of functional internal adenylation domains," Journal of bacteriology 179, 6843-6850 (1997).
Nguyen, K.T., et al. "Combinatorial biosynthesis of novel antibiotics related to daptomycin." Proceedings of the National Academy of Sciences 103.46 (2006): 17462-17467.
Pardee, K, et al., "Rapid, Low-Cost Detection of Zika Virus Using Programmable Biomolecular Components," Cell 165, 1255-1266 (2016).

(Continued)

*Primary Examiner* — Richard A Schnizer
(74) *Attorney, Agent, or Firm* — Quarles & Brady LLP

(57) ABSTRACT

Provided herein, in some embodiments, are artificial ribosomes that synthesize nonribosomal peptides, polyketides, and fatty acids with full control over peptide sequence. Also provided herein are methods for programmed synthesis of nonribosomal peptides, polyketides, and fatty acids. In particular, provided herein are methods for scalable synthesis of a wide range of antibacterial, antifungal, antiviral, and anticancer compounds.

12 Claims, 23 Drawing Sheets
(5 of 23 Drawing Sheet(s) Filed in Color)
Specification includes a Sequence Listing.

(56) References Cited

OTHER PUBLICATIONS

Pardee, K, et al. "based synthetic gene networks." Cell159.4 (2014): 940-954.
Sachdeva, Gairik, et al. "In vivo co-localization of enzymes on RNA scaffolds increases metabolic production in a geometrically dependent manner" Nucleic acids research 42.14 (2014): 9493-9503.
Sattely, E.S., et al. "Total biosynthesis: in vitro reconstitution of polyketide and nonribosomal peptide pathways" Natural product reports 25.4 (2008): 757-793.
Stachelhaus T, et al., "Modular structure of peptide synthetases revealed by dissection of the multifunctional enzyme GrsA," The Journal of biological chemistry 270, 6163-6169 (1995).
Nakano, K., & Watanabe, T. (2012). HTLV-1 Rex: the courier of viral messages making use of the host vehicle. Frontiers in microbiology, 3, 330.
Keryer-Bibens, C., Barreau, C., & Osborne, H. B. (2008). Tethering of proteins to RNAs by bacteriophage proteins. Biology of the Cell, 100(2), 125-138.
Cocozaki, A. I., Ghattas, I. R., & Smith, C. A. (2008). The RNA-binding domain of bacteriophage P22 N protein is highly mutable, and a single mutation relaxes specificity toward λ. Journal of bacteriology, 190(23), 7699-7708.

\* cited by examiner

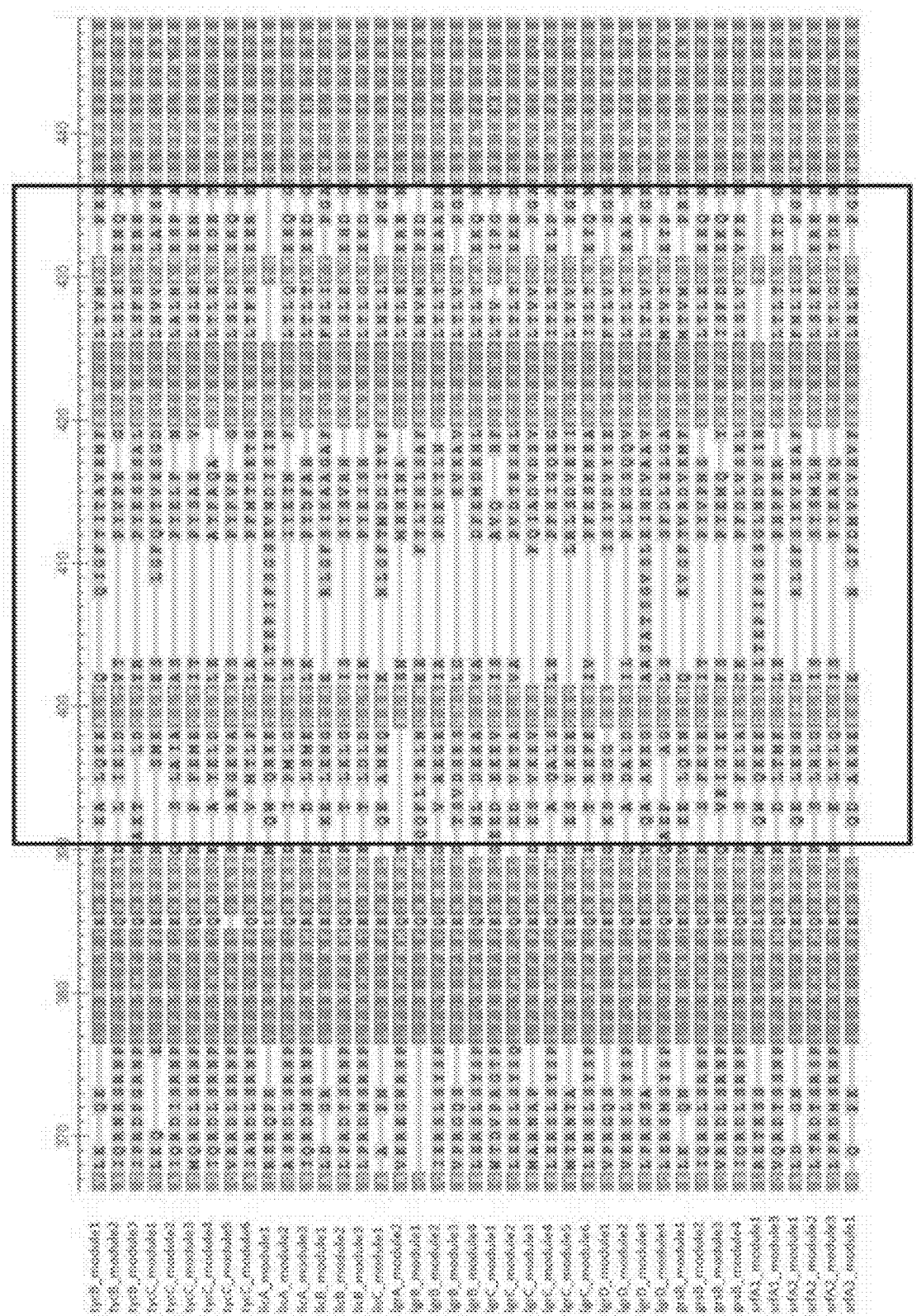

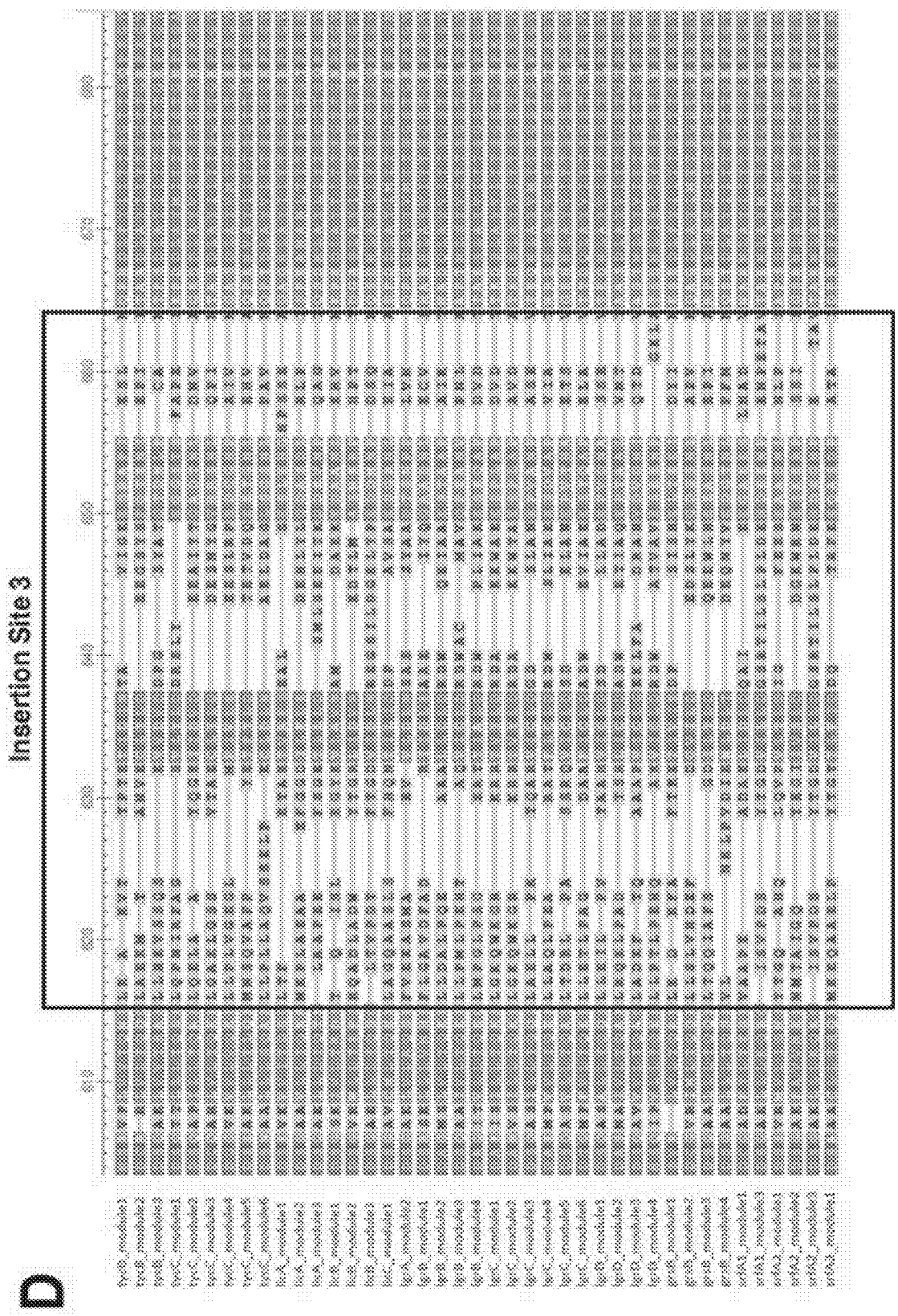

FIGS. 12A-12D
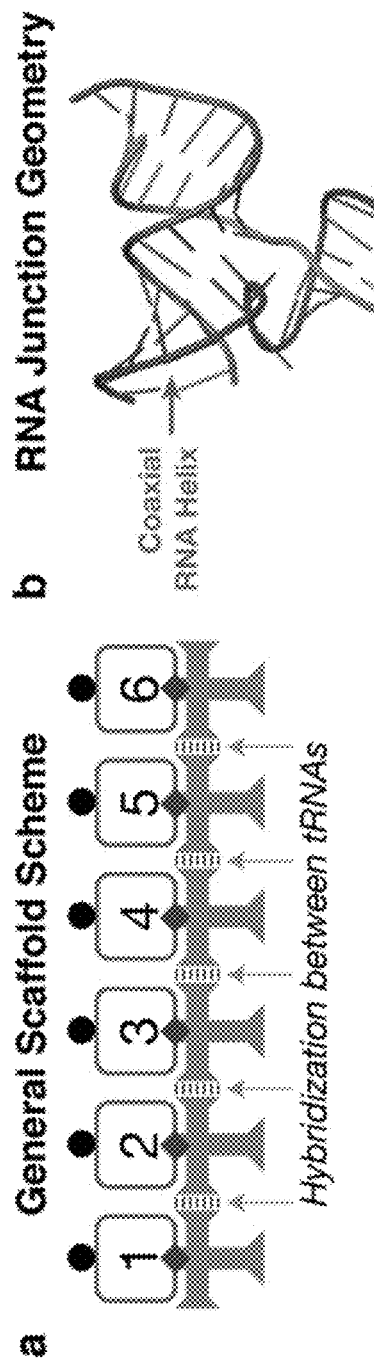
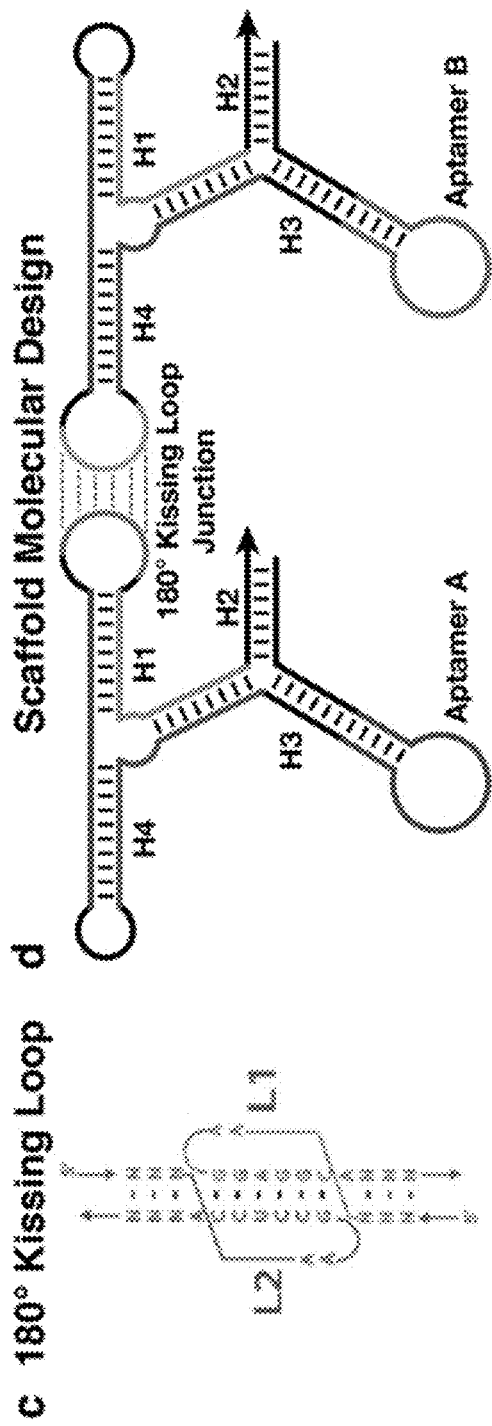

FIG. 14 Crosstalk Test with Kissing Loop 1

FIG. 17

Kissing loop (norm) strands

|  | 1 | 2 | 3 | 4 | 5 | 6 | 7 | 8 | 9 | 10 | 11 | 12 |
|---|---|---|---|---|---|---|---|---|---|---|---|---|
| 1* | 10 | 0 | 0 | 0 | 0 | 0 | 0 | 0 | 0 | 0 | 0 | 0 |
| 2* | 0 | *10* | 0 | 0 | 0 | 0 | 0 | 0 | 0 | 0 | 0 | 0 |
| 3* | 0 | 0 | 10 | 0 | 0 | 0 | 0 | 0 | 0 | 0 | 0 | 0 |
| 4* | 0 | 0 | 0 | *10* | 0 | 0 | 0 | 0 | 0 | 0 | 0 | 0 |
| 5* | 0 | 0 | 0 | 0 | 10 | 0 | 0 | 0 | 0 | 0 | 0 | 0 |
| 6* | 0 | 0 | 0 | 0 | 0 | *10* | 0 | 0 | 0 | 0 | 0 | 0 |
| 7* | 0 | 0 | 0 | 0 | 0 | 0 | 10 | 0 | 0 | 0 | 0 | 0 |
| 8* | 0 | 0 | 0 | 0 | 0 | 0 | 0 | *10* | 0 | 0 | 0 | 0 |
| 9* | 0 | 0 | 0 | 0 | 0 | 0 | 0 | 0 | 10 | 0 | 0 | 0 |
| 10* | 0 | 0 | 0 | 0 | 0 | 0 | 0 | 0 | 0 | *10* | 0 | 0 |
| 11* | 0 | 0 | 0 | 0 | 0 | 0 | 0 | 0 | 0 | 0 | *10* | 0 |
| 12* | 0 | 0 | 0 | 0 | 0 | 0 | 0 | 0 | 0 | 0 | 0 | *10* |

Kissing loop (star) strands strong interaction = bold
weak interaction (partial) = *italic*
no interaction = underlined

ARTIFICIAL RIBOSOMES FOR FULLY PROGRAMMABLE SYNTHESIS OF NONRIBOSOMAL PEPTIDES This application claims priority to U.S. Provisional Application No. 62/616,061, filed Jan. 11, 2018, which is incorporated herein by reference as it set forth in its entirety.

STATEMENT REGARDING FEDERALLY SPONSORED RESEARCH OR DEVELOPMENT

This invention was made with government support under D17AP00026 awarded by DOD/DARPA. The government has certain rights in the invention.

BACKGROUND

Nonribosomal peptides include some of the most important antibacterial, antifungal, antiviral, immunosuppressant, and anticancer drugs in use today. These compounds are synthesized by nonribosomal peptide synthetases (NRPSs) in a modular manner completely distinct from peptides and proteins synthesized by the ribosome. NRPSs display remarkable diversity in the amino acids that they can incorporate into peptides, with over 300 different residues identified to date, and the resulting peptides often adopt constrained cyclic structures that enhance their bioactivity. Despite their profound importance, the vast majority of nonribosomal peptides have been discovered as natural products, harvested from bacteria and fungi. Considerable work has been done to reconstitute NRPSs in vitro, and bio-inspired approaches have yielded synthetic libraries of these compounds. However, these efforts have failed to yield a scalable method to produce nonribosomal peptides with the same sequence control afforded by the ribosome. Accordingly, there remains a need in the art for compositions, methods, and systems for precise sequence programming of nonribosomal peptides (NRPs).

SUMMARY OF THE DISCLOSURE

Provided herein, in some embodiments, are artificial ribosomes that synthesize non-ribosomal peptides, polyketides, and fatty acids with full control over peptide sequence. These systems provide for scalable synthesis of a wide range of antibacterial, antifungal, antiviral, and anticancer compounds that could have transformative potential for clinical applications.

In a first aspect, provided herein is a molecular assembly line for programmed synthesis of a desired nonribosomal peptide, where the molecular assembly line is a three-dimensional complex comprising (a) at least one synthetic RNA scaffold that comprises at least one peptide or polypeptide binding site; and (b) at least one module of a nonribosomal peptide synthetase (NRPS), the module comprising at least one protein or peptide domain for binding to an RNA sequence, where the at least one synthetic RNA scaffold and at least one NRPS module form a complex to provide a predetermined three-dimensional arrangement of NRPS modules for programmed synthesis of the desired nonribosomal peptide. In some cases, the molecular assembly line comprises modules from at least two different modular NRPSs.

In some cases, the at least one NRPS module is selected from licA1, licA2, licB1, licB3, licC1, tycB, tycC, lgrA, lgrB, lgrC, lgrD, grsB, srfA1, srfA2, and srfA3. The at least one synthetic RNA scaffold can be a tRNA analog. The at least one NRPS module can be fused to a RNA-binding peptide selected from Lambda(G1N2R4), P22N, RevN7D, HTLV-1-Rex, and BIV-Tat. The NRPS module-RNA binding peptide fusion can be configured to binding to an aptamer site of a tRNA analog.

In another aspect, provided herein is a synthetic nucleic acid sequence encoding a molecular assembly line of the disclosure. Also provided herein is a biological cell comprising the synthetic nucleic acid sequence.

In another aspect, provided herein is a method for the production of a non-ribosomal peptide in vitro, the method comprising: (a) providing a molecular assembly line to a cell-free expression system, the molecular assembly line comprising (i) at least one synthetic RNA scaffold that comprises at least one peptide or polypeptide binding site; and (ii) at least one module of a nonribosomal peptide synthetase (NRPS), the module comprising at least one protein or peptide domain for binding to an RNA sequence, where the at least one synthetic RNA scaffold and at least one NRPS module form a complex to provide a predetermined three-dimensional arrangement of NRPS modules for programmed synthesis of specific nonribosomal peptides; (b) incubating the cell-free system containing the molecular assembly line under conditions wherein the non-ribosomal peptide is synthesized; and (c) optionally recovering the nonribosomal peptide from the cell-free system.

In some cases, the molecular assembly line comprises modules from at least two different modular NRPSs. The at least one NRPS module of the molecular assembly line can be selected from licA1, licA2, licB1, licB3, licC1, tycB, tycC, lgrA, lgrB, lgrC, lgrD, grsB, srfA1, srfA2, and srfA3. The at least one synthetic RNA scaffold can be a tRNA analog. The at least one NRPS module of the molecular assembly line can be fused to a RNA-binding peptide selected from Lambda(G1N2R4), P22N, RevN7D, HTLV-1-Rex, and BIV-Tat. The NRPS module-RNA binding peptide fusion can be configured to binding to an aptamer site of a tRNA analog.

In a further aspect, provided herein is a molecular assembly line for programmed synthesis of a desired polyketide, where the molecular assembly line is a three-dimensional complex comprising (a) at least one synthetic RNA scaffold that comprises at least one peptide or polypeptide binding site; and (b) at least one module of a polyketide synthase (PKS), the module comprising at least one protein or peptide domain for binding to an RNA sequence, where the at least one synthetic RNA scaffold and at least one PKS module form a complex to provide a predetermined three-dimensional arrangement of PKS modules for programmed synthesis of the desired polyketide.

In another aspect, provided herein is a molecular assembly line for programmed synthesis of a desired fatty acid, where the molecular assembly line is a three-dimensional complex comprising (a) at least one synthetic RNA scaffold that comprises at least one peptide or polypeptide binding site; and (b) at least one module of a fatty acid synthase (FAS), the module comprising at least one protein or peptide domain for binding to an RNA sequence, where the at least one synthetic RNA scaffold and at least one FAS module form a complex to provide a predetermined three-dimensional arrangement of FAS modules for programmed synthesis of the desired fatty acid.

In a further aspect, provided herein is a molecular assembly line for programmed synthesis of a desired hybrid polyketide nonribosomal peptide, where the molecular assembly line is a three-dimensional complex comprising (a) at least one synthetic RNA scaffold that comprises at least one peptide or polypeptide binding site; and (b) at least one module of a polyketide synthase (PKS), the module comprising at least one protein or peptide domain for binding to an RNA sequence.

BRIEF DESCRIPTION OF THE DRAWINGS

The patent or patent application file contains at least one drawing in color. Copies of this patent or patent application publication with color drawings will be provided by the Office upon request and payment of the necessary fee.

FIG. 3C. Zoomed in view of sequence alignments for the second insertion sites. SEQ ID NOs: 4, 6, 8, 10, 12, 14, 16, 18, 20, 22, 24, 26, 28, 30, 32, 34, 52, 54, 56, 58, 60, 62, 64, 66, 68, 70, 72, 74, 76, 78, 80, 84, 86, 88, 90, 36, 40, 42, 44, 46, 48.

FIG. 3D. Zoomed in view of sequence alignments for the third insertion sites. SEQ ID NOs: 4, 6, 8, 10, 12, 14, 16, 18, 20, 22, 24, 26, 28, 30, 32, 34, 52, 54, 56, 58, 60, 62, 64, 66, 68, 70, 72, 74, 76, 78, 80, 84, 86, 88, 90, 36, 40, 42, 44, 46, 48.

FIGS. 12A-12D are schematics illustrating co-hybridizing tRNA analog design principles. A, General concept for co-hybridizing tRNA analogs where kissing loops are used to promote inter-tRNA binding, while aptamer sites enable formation of linear NRPS assemblies. B, Structure of the coaxial RNA helix (blue strand) in packaging RNA (pRNA) used by bacteriophages. C, The secondary structure of RNA kissing loops from the HIV virus. Nine-nucleotide loop domains in stem-loops can hybridize with one another to form 180° junctions. Image taken from Grabow et al., *Nano Lett.* 11, 878-887 (2011). D, Schematic of the scaffold molecular design in which coaxial tRNA duplexes are joined co-linearly through HIV kissing loop junctions. The resulting assemblies provide aptamer sites for binding NRPS fusions.

FIG. 17 demonstrates overall orthogonality between norm and star kissing loops. Optimal set of orthogonal kissing loops is highlighted in bold font. Pairs shown in italic font showed weak or partial interaction, while the loops shown in underlined font, with lower GC content, did not hybridize at 37° C.

Figures 1A, 1B, 1C:
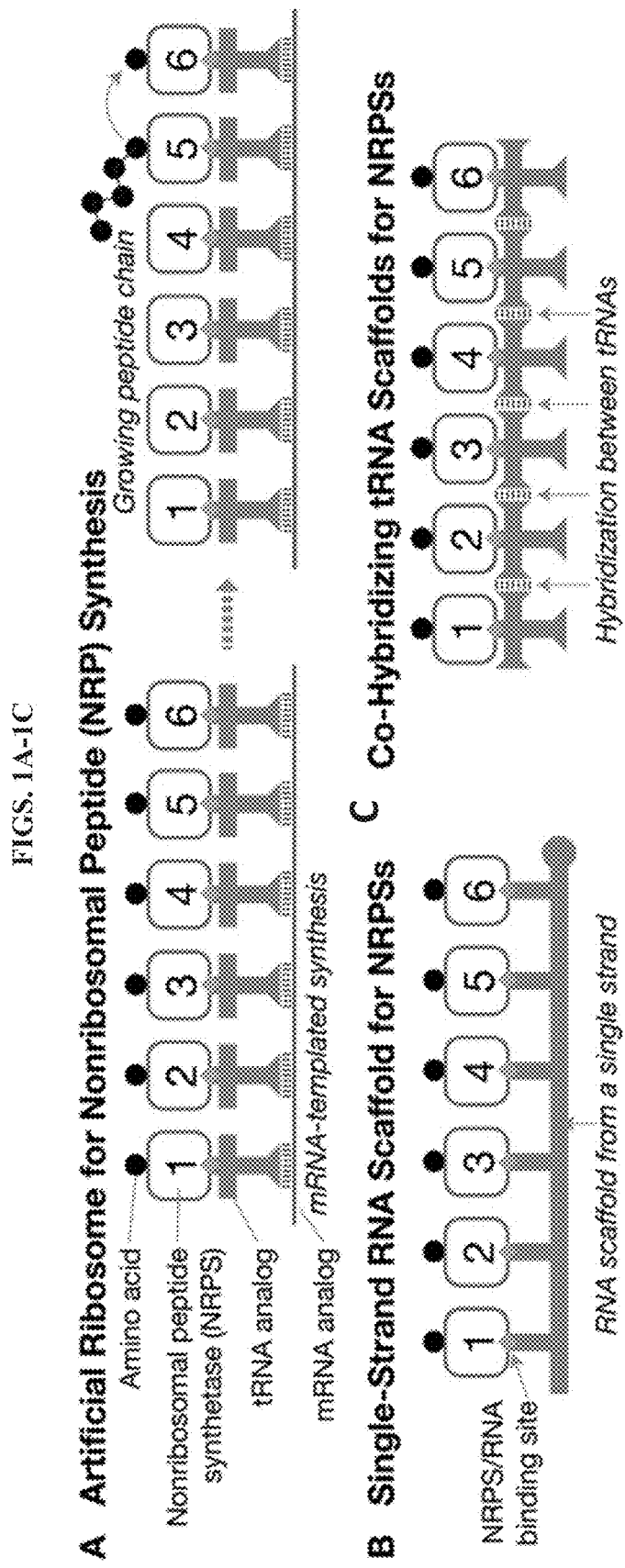
FIGS. 1A-1C are schematics illustrating assembly lines for non-ribosomal peptide (NRP) synthesis. A, Artificial ribosome concept employs mRNA-templated NRPS positioning for programmable NRP synthesis. B, Simplified single RNA scaffold that provides binding sites for distinct NRPSs. C, Co-hybridizing tRNAs provide modular NRPS ordering.

While the present invention is susceptible to various modifications and alternative forms, exemplary embodiments thereof are shown by way of example in the drawings and are herein described in detail. It should be understood, however, that the description of exemplary embodiments is not intended to limit the invention to the particular forms disclosed, but on the contrary, the intention is to cover all modifications, equivalents and alternatives falling within the spirit and scope of the invention as defined by the appended claims.

DETAILED DESCRIPTION

All publications, including but not limited to patents and patent applications, cited in this specification are herein incorporated by reference as though set forth in their entirety in the present application.

The compositions and methods described herein are based, at least in part, on the inventors' development of artificial RNA scaffolds that can be programmed to adopt virtually any geometry. The artificial scaffolds are based on the modular organization of enzyme components, in which modules of each enzyme are responsible for the activation and incorporation of a single unit (e.g., amino acid, fatty acid) to build a nonribosomal peptide, fatty acid, or polyketide. The modules are arranged in a colinear fashion with the product molecule. For the first time, compositions and methods are provided in which multiple modular components (e.g., modules of nonribosomal peptide synthetases (NRPSs), polyketide synthases, fatty acid synthases are precisely arranged to facilitate the synthesis of entirely new molecules.

For any of the embodiments described herein, NRPS modules can be replaced by enzyme modules used for fatty acid or polyketide synthesis. Polyketides are synthesized by polyketide synthetases (PKSs) that are arranged in a defined molecular assembly line to catalyze biosynthesis of polyketides. Fatty acid synthases (FASs) are synthesized in similar manner. Accordingly, this disclosure provides molecular assembly lines for programmed fatty acid or polyketide synthesis, where the molecular assembly lines comprise a RNA scaffold as described herein and one or more (in some cases, two, three, or more) PKS or FAS enzyme modules in place of NRPS modules.

In a first aspect, provided herein are molecular assembly lines configured for programmed synthesis of a desired nonribosomal peptide. In some cases, the molecular assembly line is a three-dimensional complex comprising (a) at least one synthetic RNA scaffold that comprises at least one peptide or polypeptide binding site; and (b) at least two modules of a nonribosomal peptide synthetase, each module comprising at least one RNA-binding domain, meaning a protein or peptide domain for binding to an RNA sequence. The synthetic RNA scaffold and NRPS modules form a complex to provide a predetermined three-dimensional arrangement of NRPS modules for programmed synthesis of a desired nonribosomal peptide.

As used herein, the term "molecular assembly line" refers to a three-dimensional complex comprising (i) a synthetic RNA molecule that comprises one or more peptide or polypeptide binding domains, and (ii) two or more nonribosomal peptide synthetase modules, each module having a RNA binding domain. The synthetic RNA scaffold forms a NRPS/RNA complex with the NRPS modules and is preferably configured for programmable synthesis of a target nonribosomal peptide based on arrangement of particular NRPS modules. In certain embodiments, the synthetic RNA scaffold is designed such that NRPS modules are in a particular defined order in the NRPS/RNA complex. In this manner, the artificial ribosome recapitulates RNA-protein interactions of a ribosome. RNA scaffolds and NRPS modules can be integrated in various arrangements to program synthesis of various nonribosomal peptides.

By "nonribosomal peptide," "nonribsomally synthesized peptide," or "NRP" is meant any polypeptide not produced by a ribosome. NRPs may be linear, cyclized or branched and contain proteinogenic, natural or non-natural amino acids, or any combination thereof. NRPs include peptides produced by a nonribosomal peptide synthetase assembly line.

NRPs are synthesized by large enzymatic complexes called nonribosomal peptide synthetases (NRPSs). By "nonribosomal peptide synthetase," "nonribosomal peptide synthase," or NRPS is meant a polypeptide or series of interacting polypeptides that produce a nonribosomal peptide and, thus, is able to catalyze peptide bond formation without the presence of ribosomal components. Genes coding for NRPS are organized in operons or in clusters. NRPSs are modularly organized. Each module is responsible for the incorporation of a specific monomer. Modules are subdivided into domains, each domain catalyzing a specific reaction in the incorporation of a monomer. A "module" is one or a set of distinctive domains that encode all the enzyme activities necessary for one cycle of peptide chain elongation and associated modifications. The number and order of modules and the type of domains within a module on each NRPS protein determine the structural variations of the resulting peptide products by dictating the number, order, choice of the amino acid to be incorporated, and the modifications associated with a particular cycle of elongation. Typically, the enzyme organization of an NRPS gene cluster is such that the modules are co-linear with the peptide product, meaning the modules occur in the primary sequence in the same order that the amino acids are assembled into the peptide product.

Generally, NRPSs comprise primary domains catalyze activation (adenylation domain), covalent binding (the thiolation or peptidyl carrier protein domain), and elongation (C domain). A NRPS may also contain secondary domains that allow residue modifications (e.g., methylation, oxidation, cyclization, epimerization (incorporation of D-amino acids)) and peptide release (thioesterase domain).

As used herein, the term "modular" refers to the fact that prepared nucleic acid parts (modules) can be ligated with any other prepared nucleic acid parts without dependencies on the nucleic acid sequence of the two parts. The modular design of molecular assembly lines of this disclosure allows for multiple, flexible configurations of individual RNA scaffolds and NRPS modules.

The molecular assembly lines described herein harness features of a modular NRPS pathway responsible for the synthesis of various nonribosomal peptides. In some cases, the modules are selected from the modular NRPS pathway for synthesis of the antibiotic tyrocidine. The ten amino-acid peptide tyrocidine (Tyc) is synthesized by three distinct nonribosomal peptide synthetases (NRPSs): TycA, TycB, and TycC. These NRPSs are responsible for incorporating one, three, and six different amino acids into the peptide chain, respectively. Previous studies have shown that short peptide communication domains promote assembly of the three NRPS into a megadalton complex to enable tyrocidine synthesis. Furthermore, the individual modules that incorporate each peptide into the tyrocidine NRP have been identified and confirmed to be independently active, indicating that they are prime candidates for incorporation into programmable assembly lines for tyrocidine synthesis. The individual tyrocidine NRPS modules also display substantial homology, which can be used to identify good sites for incorporation of RNA binding domains into the modules. Lastly, tyrocidine NRPSs have known initiation and termination modules that will be used to initiate and terminate peptide synthesis in the proposed NRPS/RNA assembly lines.

In other cases, the molecular assembly line comprises modules derived from the modular operons for synthesis of peptide antibiotics related to tyrocidine such as, for example, bacitracin, gramicidin (lgr), surfactin (srf), lichenysin (lic), and gramicidin S (grs). For example, molecular assembly line can comprise modules derived from lichenysin NRPSs such as licA, licB, and licC. The NRPS licA, for instance, can provide modules licA1, licA2, and licA3, each responsible for incorporation of a single amino acid. Likewise, the NRPS licB can provide modules licB1, licB2, and licB3, each responsible for incorporation of a single amino acid. NRPSs of other exemplary nonribosomal peptides are set forth in Table 1.

TABLE 1

| NRPSs of Exemplary Nonribosomal Peptides | |
|---|---|
| Nonribosomal Peptide | NRPSs |
| tyrocidine (tyc) | tycA, tycB, tycC |
| lichenysin (lic) | licA, licB, licC |

TABLE 1-continued

| NRPSs of Exemplary Nonribosomal Peptides | |
|---|---|
| Nonribosomal Peptide | NRPSs |
| gramicidin (lgr) | lgrA, lgrB, lgrC, lgrD |
| surfactin (srf) | srfA-A, srfA-B, srfA-C, srfA-D |
| gramicidin S (grs) | grsA, grsB |
| bacillomycin L (bmy) | bmyD, bmyA, bmyB, bmyC |
| fengycin (fen) | fenA, fenB, fenC, fenD, fenE |
| locillomycin (loc) | locD, locA, locB, locC |
| Bacitracin (bac) | bacA, bacB, bacC |

In some cases, one or more modules are fused to a RNA-binding peptide. Exemplary RNA binding peptides include, without limitation, LambdaN(G1N2R4), P22N, RSG1.2, HTLV-1-Rex, RevN7D, or BIV-Tat.

In some cases, PKS modules can be derived from an ery operon for erythromycin A synthesis, a rap operon for rapamycin synthesis, a rif operon for rifamycin synthesis, a fkb operon for FK506 synthesis, an aveA operon for avermectin synthesis, a nidA operon for niddamycin synthesis, or a pikA operon for pikromycin synthesis.

Fatty acid synthase modules can be derived from the fab operon in $E.$ $coli$ and related operons in other bacteria. Fungi and animals also have fatty acid synthases.

In certain embodiments, the NRPS module is capable of binding to an RNA scaffold at more than one RNA-binding site. Without being bound to any particular theory or mode of action, it is believed that tethering a NRPS module at two positions provides for precise control of enzyme orientation and location within the molecular assembly line.

As described herein, molecular assembly lines of this disclosure can have different configurations that provide for different degrees of complexity and modularity. For example, in some cases, the synthetic RNA scaffold of the molecular assembly line further comprises binding domains specific for binding to other RNAs. Referring to FIG. 1A, the RNA scaffold can be configured to bind to an mRNA analog that serves as a template to provide for specific ordering of NRPS/RNA complexes. As illustrated in FIG. 1A, such RNA scaffolds can comprise a single binding site for one NRPS module. In other embodiments, the RNA scaffold comprises binding sites for association with more than one NRPS module bound. The assembly line configuration shown in FIG. 1A is referred to herein as an "artificial ribosome" as it employs an mRNA analog to template the binding of tRNA analogs loaded with specific NRPS modules and, thus, recapitulates the underlying RNA-protein interactions of a ribosome. By using an mRNA-templated reaction, the artificial ribosome provides the highest degree of modularity for NRP synthesis. To eliminate binding between the tRNAs, the sequences used for hybridization between tRNAs can be converted to poly-A sequences. mRNA sequences can be optimized to ensure that only a specified order of tRNAs can be assembled into a functional artificial ribosome.

In some cases, mRNA analogs of different lengths are used to vary NRPS reaction yields and purity. Furthermore, so-called three-letter alphabets, in which only C, A, and U, or G, A, and U bases are used to reduce overall mRNA secondary structure. In some cases, tRNA codons are optimized to ensure they comprise divergent sequences. In vitro experiments can be conducted to increase the diversity (e.g., length, sequence, amino acid content) of the NRPs synthesized.

In some cases, the RNA scaffold is designed to bind to other RNA scaffold elements. The assembly line configuration illustrated in FIG. 1C comprises multiple transfer RNA (tRNA) analogs that load specific NRPS modules and bind to neighboring tRNAs in the arrangement of NRPS modules. In the embodiment illustrated in FIG. 1C, the RNA scaffold has a single NRPS module bound to it. In other embodiments, the RNA scaffold can have more than one bound NRPS module. As shown in FIG. 1C, the RNA scaffold can comprise multiple tRNA analogs that hybridize at their arms to form the NRPS assembly line. By programming the sequences of the tRNA arms, the precise order of NRPSs can be specified. In this configuration, tRNAs can be readily modified to bind to different neighbors. More modular RNA scaffolds are better suited for readily generating different NRP sequences, but employ multiple RNAs that must hybridize with one another, which can reduce assembly yields.

In another configuration, the molecular assembly line comprises a single strand of RNA designed to fold into a scaffold for precise NRPS docking. In some cases, the single-strand RNA scaffold contains binding sites two or more NRPSs. As illustrated in FIG. 1B, the single-strand scaffold is relatively simple to construct, but it lacks modularity because the RNA must be substantially redesigned whenever the NRP sequence changes. RNA sequence design software can be used to program a RNA scaffold to fold into a desired structure. The predictable structural properties of RNA (e.g., base pairs per turn, diameter) make it possible to precisely specify the placement of the NRPS binding locations in a three-dimensional complex space. Increasing numbers of enzyme binding sites can be added simply by extending the length of the RNA scaffold. Unlike the configurations of FIG. 1A and FIG. 1C, the RNA scaffold of configuration FIG. 1B does not bind to other RNA scaffolds. Instead, the RNA scaffold is configured to bind to multiple NRPS modules.

In some cases, the molecular assembly line comprises a synthetic RNA scaffold and two or more modules for the programmed synthesis of a NRP-polyketide hybrid.

In some cases, the molecular assembly line comprises a synthetic RNA scaffold and modules of at least three different NRPSs.

In certain embodiments, the molecular assembly line is genetically encoded, meaning that an mRNA encoding the RNA scaffold and enzyme synthesis modules of the molecular assembly line is produced within a cell.

In another aspect, provided herein are methods for using molecular assembly lines for NRP synthesis in both in vitro and in vivo applications. For example, artificial ribosomes will for the first time provide for fully programmable synthesis of nonribosomal peptides and enable large-scale library-based screening and in vitro selection procedures to be applied to such highly bioactive compounds. The compounds produced by the artificial ribosomes described herein provide an immensely valuable source of new drug candidates.

For scalable NRP biosynthesis, synthetic nucleic acids encoding a molecular assembly line described herein can be introduced into a cell, such as a bacterium (e.g., E. coli), for in vitro expression of a desired NRP. Such methods are advantageous for scalable synthesis of nonribosomal peptides useful as antibacterial, antifungal, antiviral, and anticancer compounds. Accordingly, the methods provided herein have transformative potential for clinical applications.

In some cases, a cell-free expression system is used for in vitro production of a desired NRP. As used herein, the terms "cell-free system" and "cell-free expression system" refer to a cell lysate, cell extract or other preparation in which substantially all of the cells in the preparation have been disrupted or otherwise processed so that all or selected cellular components, e.g., organelles, proteins, nucleic acids, the cell membrane itself (or fragments or components thereof), or the like, are released from the cell or resuspended into an appropriate medium and/or purified from the cellular milieu. Cell-free systems include, of course, reaction mixtures prepared from purified or isolated proteins and suitable reagents and buffers.

In some cases, a method for the production of a non-ribosomal peptide in vitro comprises (a) providing a molecular assembly line to a cell-free expression system, the molecular assembly line comprising (i) at least one synthetic RNA scaffold that comprises at least one peptide or polypeptide binding site; and (ii) at least one module of a nonribosomal peptide synthetase (NRPS), the module comprising at least one protein or peptide domain for binding to an RNA sequence, wherein the at least one synthetic RNA scaffold and at least one NRPS module form a complex to provide a predetermined three-dimensional arrangement of NRPS modules for programmed synthesis of specific nonribosomal peptides; (b) incubating the cell-free system containing the molecular assembly line under conditions wherein the non-ribosomal peptide is synthesized; and (c) optionally recovering (e.g., purifying, isolating) the non-ribosomal peptide from the cell-free system. By "purified" or "isolated" is meant, when referring to a polypeptide or nucleotide sequence, that the indicated molecule is separate and discrete from the whole organism from which the molecule is normally associated in nature. Thus, a protein contained in a cell free system would constitute a "purified" or "isolated" protein, as would a protein further purified from a cell-free extract. In addition, a "purified" or "isolated" protein refers to a protein which has been synthetically or recombinantly produced and, optionally, purified from the host cell.

The availability of cell-free systems for the production of NRPs provides a unique opportunity to generate libraries of NRPs by varying the nature of the molecular assembly line and, in particular, varying the arrangement of NRPS modules of the RNA/NRPS complex. In some cases, NRP libraries are useful for drug discovery methods such as high-throughput screens.

In other cases, cell-free expression systems are used with molecular assembly lines of this disclosure to provide for portable, on-demand synthesis of a target nonribosomal peptide. Such applications are suitable for use in the field.

NRPs, polyketides, and fatty acids that are prepared according to the methods disclosed herein may be isolated and identified using any of a variety of techniques known in the art including, without limitation, thin layer chromatography, high performance liquid chromatography, analytical and/or preparative gel electrophoresis, column chromatography, gas chromatography, nuclear magnetic resonance ("NMR"), mass spectrometry, or other conventional methods well known in the art.

Unless defined otherwise, all technical and scientific terms used herein have the same meaning as commonly understood by one of ordinary skill in the art to which the invention pertains. All definitions, as defined and used herein, should be understood to control over dictionary definitions, definitions in documents incorporated by reference, and/or ordinary meanings of the defined terms.

All references, patents and patent applications disclosed herein are incorporated by reference with respect to the subject matter for which each is cited, which in some cases may encompass the entirety of the document.

The indefinite articles "a" and "an," as used herein in the specification and in the claims, unless clearly indicated to the contrary, should be understood to mean "at least one."

The phrase "and/or," as used herein in the specification and in the claims, should be understood to mean "either or both" of the elements so conjoined, i.e., elements that are conjunctively present in some cases and disjunctively present in other cases. Multiple elements listed with "and/or" should be construed in the same fashion, i.e., "one or more" of the elements so conjoined. Other elements may optionally be present other than the elements specifically identified by the "and/or" clause, whether related or unrelated to those elements specifically identified. Thus, as a non-limiting example, a reference to "A and/or B", when used in conjunction with open-ended language such as "comprising" can refer, in one embodiment, to A only (optionally including elements other than B); in another embodiment, to B only (optionally including elements other than A); in yet another embodiment, to both A and B (optionally including other elements); etc.

As used herein in the specification and in the claims, "or" should be understood to have the same meaning as "and/or" as defined above. For example, when separating items in a list, "or" or "and/or" shall be interpreted as being inclusive, i.e., the inclusion of at least one, but also including more than one, of a number or list of elements, and, optionally, additional unlisted items. Only terms clearly indicated to the contrary, such as "only one of" or "exactly one of," or, when used in the claims, "consisting of," will refer to the inclusion of exactly one element of a number or list of elements. In general, the term "or" as used herein shall only be interpreted as indicating exclusive alternatives (i.e. "one or the other but not both") when preceded by terms of exclusivity, such as "either," "one of," "only one of" or "exactly one of." "Consisting essentially of," when used in the claims, shall have its ordinary meaning as used in the field of patent law.

As used herein, the terms "approximately" or "about" in reference to a number are generally taken to include numbers that fall within a range of 5% in either direction (greater than or less than) the number unless otherwise stated or otherwise evident from the context (except where such number would exceed 100% of a possible value). Where ranges are stated, the endpoints are included within the range unless otherwise stated or otherwise evident from the context.

As used herein, the terms "optional" or "optionally" mean that the subsequently described event or circumstance may or may not occur, and that the description includes instances where said event or circumstance occurs and instances where it does not.

The present invention has been described in terms of one or more preferred embodiments, and it should be appreciated that many equivalents, alternatives, variations, and modifications, aside from those expressly stated, are possible and within the scope of the invention.

EXAMPLES

Example 1—NRPS Module Isolation and Characterization

We cloned NRPS modules from strains of bacteria having well characterized NRPS operons. We acquired the bacterial strains for biosynthesis of the nonribosomal peptides tyrocidine (Tyc), gramicidin (Lgr), surfactin (Srf), and lichenysin (Lic). A strain that synthesizes gramicidin S (Grs) will be obtained. The NRPS complexes for Tyc, Lgr, Srf, Lic, and Grs contain a total of 45 different NRPS modules responsible for the addition of individual amino acid residues to the nonribosomal peptide. A single NRPS protein can contain multiple NRPS modules. Thus, we used published sequencing data to identify the boundaries between adjacent NRPS modules and designed 45 pairs of primers to amplify each module from the genome of the bacterial source strain and insert the module into an expression vector using Gibson assembly. The PCR primers successfully amplified the NRPS modules, producing DNA products of the expected molecular weight. Expression plasmids were generated using standard protocols.

Figure 2:
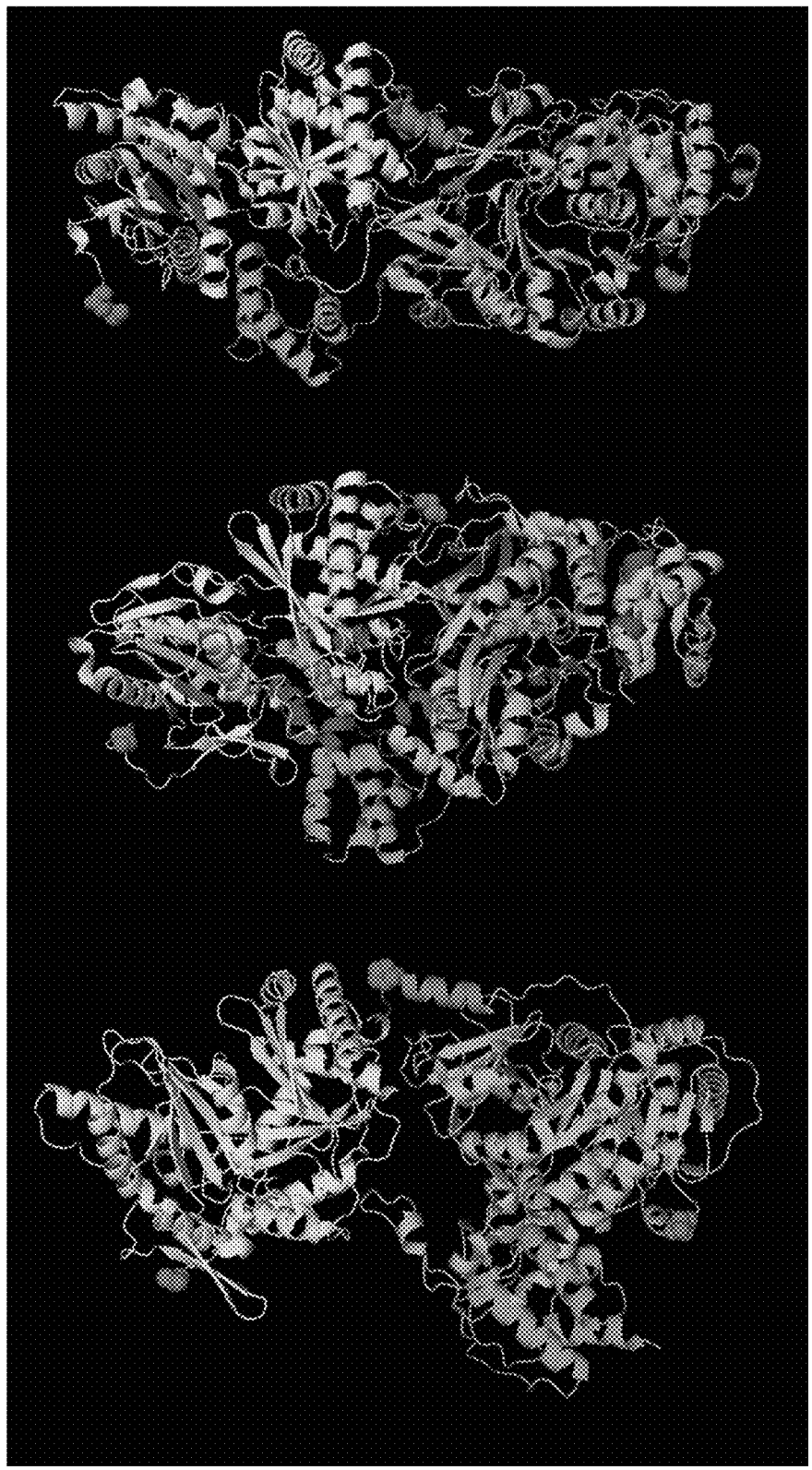
FIG. 2. Crystal structures of three NRPS modules. From left to right, Holo-EntF (PDB: 5T3D), Holo-AB3403 (PDB: 5T3E), SrfA1-3 (PDB: 2VSQ). Condensation (yellow), adenylation (cyan), and PCP (green) domains are labelled by color. The conserved domains of typical NRPS modules are shown in red in the middle Holo-AB3403 structure. Magenta spheres mark three promising insertion sites for RNA-binding peptides in the top, middle, and bottom of the enzyme crystal structures.

Using NRPS crystal structures and sequence homology, we identified multiple promising insertion sites for adding RNA-binding peptide to the NRPS modules. We first examined crystal structures of three NRPS modules: SrfA1-3, EntF, and AB3403. These modules contain the three principal NRPS domains: the adenylation domain (A), responsible for activation of the amino acid; the peptidyl carrier domain (PCP), where the Ppant prosthetic group which is tethered to the amino acid is attached; and the condensation domain (C), which catalyzes the formation of the peptide bond. By inspecting the crystal structures, we identified three locations suitable for insertion of a RNA-binding peptide based on their low degree of homology, which indicates they are not critical to enzyme function, and compatibility for positioning with neighboring NRPS modules. These sites are indicated by the magenta color in FIG. 2 and are located at the N terminus of the C domain, between the C and A domains, and in an internal loop in the A domain.

Figure 3A:
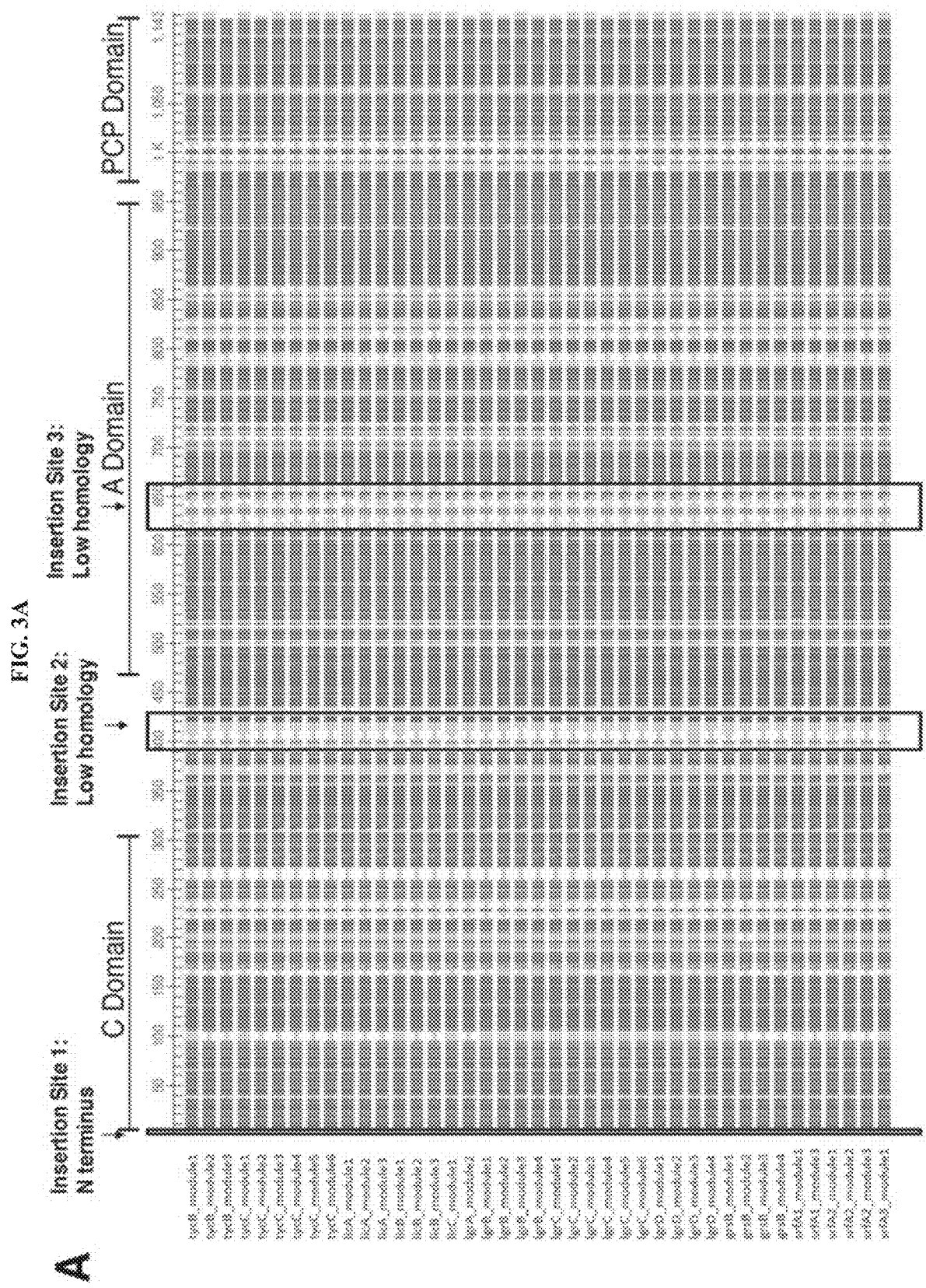
FIG. 3A. Sequence alignment of the C, A, and PCP domains for NRPS modules indicating sites of low homology for incorporation of peptides. SEQ ID NOs: 4, 6, 8, 10, 12, 14, 16, 18, 20, 22, 24, 26, 28, 30, 32, 34, 52, 54, 56, 58, 60, 62, 64, 66, 68, 70, 72, 74, 76, 78, 80, 84, 86, 88, 90, 36, 40, 42, 44, 46, 48.
Figure 3B:
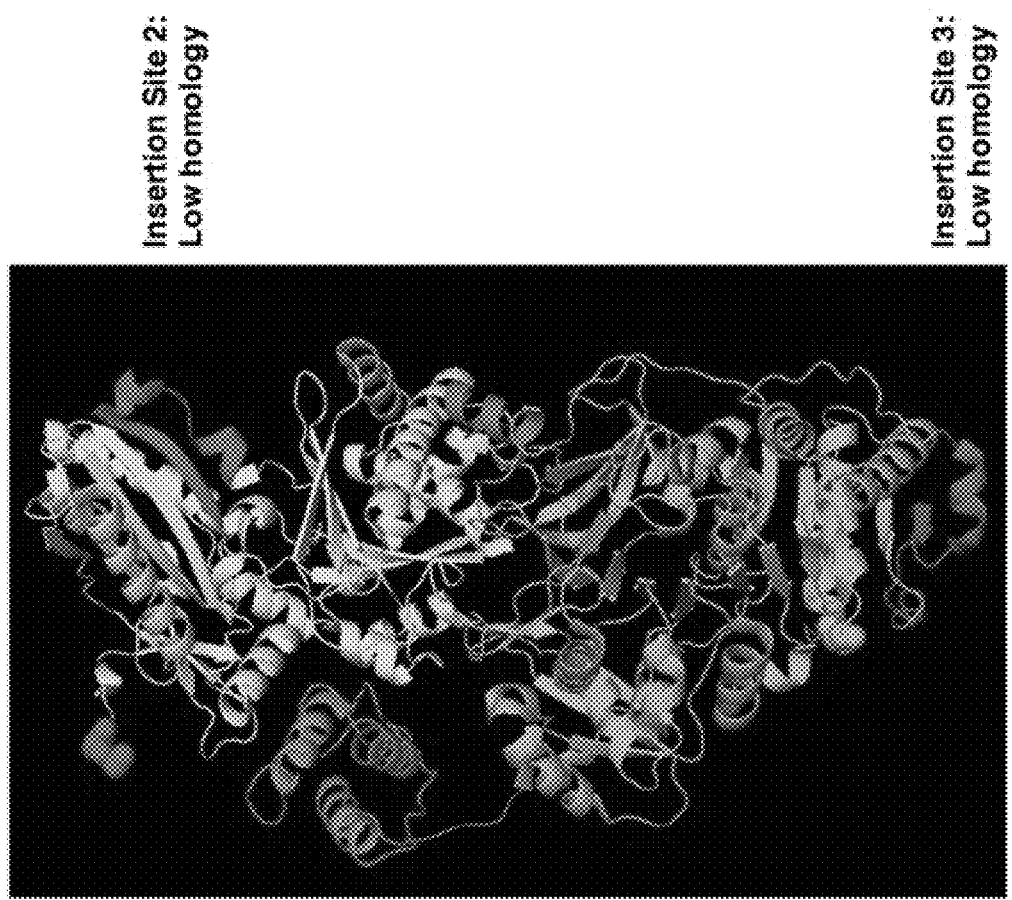
FIG. 3B. Crystal structure of SrfA1-3 with the insertion sites shown in magenta.

Of the three enzymes, only SrfA1-3 is included in our list of the 45 selected NRPS modules. Consequently, we extended the analysis to the other 44 NRPS enzymes. Using the original set of three sites as a guide, we evaluated sequence homologies across all 45 NRPS modules and identified corresponding or nearby insertion sites for all of the enzymes. The sequence homology analysis for the full set of NRPS modules is shown in FIG. 3A (SEQ ID NOs are outlined in Table 2) and the final three sites compatible with the 45 NRPS enzymes are shown in magenta in SrfA1-3 (FIG. 3B). The N terminal site remains the same, but the site between the adenylation and condensation domains has been shifted further into the yellow condensation domain region. Similarly, the domain near the bottom of the enzyme (FIG. 2, right) located within an internal loop of the A domain has been shifted further to the bottom of the enzyme (FIG. 3B). More detailed sequence alignment data for these insertion sites are shown in FIGS. 3C, 3D. Once we have successfully cloned and expressed the SrfA1-3 NRPS module, we plan to measure enzyme activity with RNA-binding peptides incorporated at each of the sites shown in FIG. 2 and FIG. 3B.

TABLE 2

| SEQ ID NOs for selected NRPS modules | | |
|---|---|---|
| NRPS Module Name | DNA sequence SEQ ID NO: | Amino Acid SEQ ID NO: |
| tycA_mod1 | 1 | 2 |
| tycB_mod1 | 3 | 4 |
| tycB_mod2 | 5 | 6 |
| tycB_mod3 | 7 | 8 |

TABLE 2-continued

SEQ ID NOs for selected NRPS modules

| NRPS Module Name | DNA sequence SEQ ID NO: | Amino Acid SEQ ID NO: |
|---|---|---|
| tycC_mod1 | 9 | 10 |
| tycC_mod2 | 11 | 12 |
| tycC_mod3 | 13 | 14 |
| tycC_mod4 | 15 | 16 |
| tycC_mod5 | 17 | 18 |
| tycC_mod6 | 19 | 20 |
| licA_mod1 | 21 | 22 |
| licA_mod2 | 23 | 24 |
| licA_mod3 | 25 | 26 |
| licB_mod1 | 27 | 28 |
| licB_mod2 | 29 | 30 |
| licB_mod3 | 31 | 32 |
| licC_mod1 | 33 | 34 |
| srfA1_mod1 | 35 | 36 |
| srfA1_mod2 | 37 | 38 |
| srfA1_mod3 | 39 | 40 |
| srfA2_mod1 | 41 | 42 |
| srfA2_mod2 | 43 | 44 |
| srfA2_mod3 | 45 | 46 |
| srfA3_mod1 | 47 | 48 |
| lgrA_mod1 | 49 | 50 |
| lgrA_mod2 | 51 | 52 |
| lgrB_mod1 | 53 | 54 |
| lgrB_mod2 | 55 | 56 |
| lgrB_mod3 | 57 | 58 |
| lgrB_mod4 | 59 | 60 |
| lgrC_mod1 | 61 | 62 |
| lgrC_mod2 | 63 | 64 |
| lgrC_mod3 | 65 | 66 |
| lgrC_mod4 | 67 | 68 |
| lgrC_mod5 | 69 | 70 |
| lgrC_mod6 | 71 | 72 |
| lgrD_mod1 | 73 | 74 |
| lgrD_mod2 | 75 | 76 |
| lgrD_mod3 | 77 | 78 |
| lgrD_mod4 | 79 | 80 |
| grsA_mod1 | 81 | 82 |
| XgrsB_mod1 | 83 | 84 |
| XgrsB_mod2 | 85 | 86 |
| XgrsB_mod3 | 87 | 88 |
| XgrsB_mod4 | 89 | 90 |

Experiments are underway to evaluate multivalent RNA scaffolds for positioning proteins using RNA aptamer/RNA-binding peptide interactions. Table 3 lists 11 RNA/peptide pairs to be evaluated for use in protein positioning. Unlike more widely studied RNA/protein systems like MS2 and PP7 where a protein of approximately 200 residues is used to bind RNA, all the peptides in Table 3, apart from PP7 itself, have very short lengths of 29 residues or fewer. Short peptides are expected to be less perturbative when they are incorporated into NRPS modules.

TABLE 3

RNA-binding peptide/aptamer pairs

| Peptide name | Peptide length (aa) | Aptamer length (nt) | Stem length (nt) | $K_d$ | Description |
|---|---|---|---|---|---|
| BMVGag | 19 | 30 | 0 | 20 nM | arginine rich motif derived from Gag protein in brome mosaic virus |
| BIV_Tat | 17 | 28 | 6 | 60 nM | arginine rich motif derived from TAT protein in ovine immunodeficiency virus |
| RSG1.2 | 22 | 34 | 6 | 6 nM | synthetic peptide that binds to the HIV Rev responsive element (RRE) |
| RevN7D | 17 | 30 | 0 | 120 nM | Mutant motif of an HIV regulatory protein that binds to the Rev responsive element |
| LambdaN | 23 | 18 | 6 | 90 nM | RNA-binding domain of the lambda bacteriophage antiterminator protein N |
| LambdaN(G1N2R4) | 23 | 15 | 5 | 12 pM | Designed arginine-rich RNA-binding peptides from bacteriophage ARM |
| P22N | 24 | 21 | 8 | 200 pM | P22 Bacteriophage ARMs necessary for transcription antitermination |
| FMRP_RGG | 29 | 36 | 6 | 3.8 nM | an arginine-glycine-rich RGG peptide from the human fragile X mental retardation protein (FMRP) |
| RevR11Q | 18 | 30 | 0 | 100 nM | Mutant motif of an HIV regulatory protein |
| HTLV-1 Rex | 17 | 36 | 4 | 270 nM | Rex peptide from human T-cell leukemia virus type 1 (HTLV-1) |
| PP7 | 254 | 25 | 10 | 2 nM | Coat protein from *Pseudomonas* phage PP7 |

Figures 4A, 4B, 4C, 4D:
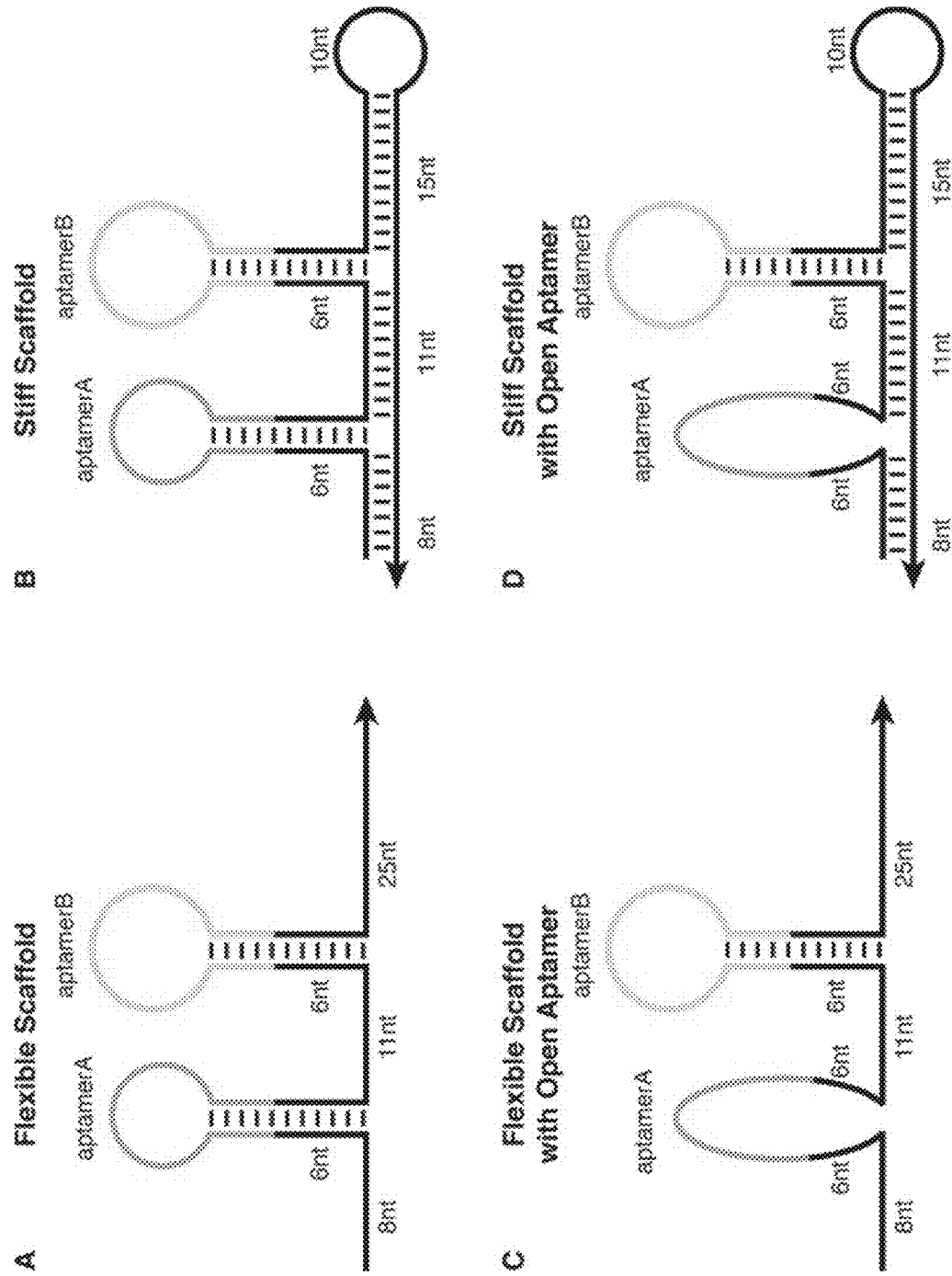
FIGS. 4A-4D. General design of bivalent RNA scaffolds used for binding two proteins. Scaffolds were designed for different levels of flexibility/stiffness and used different methods of incorporating stem-loop aptamers and open aptamers lacking stems.

Bivalent RNA scaffold design. We used NUPACK, a nucleic acid sequence design software package, to generate RNA scaffolds having different combinations of the RNA aptamers. The general structure of these bivalent scaffolds is shown in FIGS. 4A-4D. Each scaffold was designed with a flexible and a stiff version. The former has the two aptamers separated by a flexible single-stranded domain and the latter has the two aptamers separated by a more rigid double-stranded domain. The length of the domain between aptamers was designed to be 11-bp, which corresponds to one full turn in the A-form RNA double helix. The aptamer structures were also divided between those containing stem loops ("stem-loop aptamers") and those with open, stem-loop-free configurations ("open aptamers"). For the stem-loop aptamers, we extended their stems by 6 nts to increase their thermodynamic stability and promote proper folding (FIGS. 4A, 4B). For the open aptamers, we replaced the 6-nt stem with two 6-nt single-stranded domains on either side of the aptamer (FIGS. 4C, 4D).

The target RNA scaffold secondary structures and aptamers were then used to generate synthetic RNA sequences with the intended folds using NUPACK. To reduce sequence-dependent effects and lower DNA costs, the flexible and stiff scaffolds were designed simultaneously in NUPACK so that they would share the same sequences up to the 10-nt end loop in the stiff scaffold. The resulting pair of scaffolds could thus be generated from the same DNA template using separate PCR primers to amplify from the 10-nt loop or the 3' end of the template. We completed design of all 220 different bivalent scaffolds and have received their corresponding DNA templates and PCR primers. We have confirmed that the flexible and stiff scaffolds can be amplified successfully from the same DNA template and will transcribe and test the scaffolds once we have synthesized their corresponding splitGFP-peptide fusions.

Cloning and expression of splitGFP-peptide fusions. We plan to test the effectiveness of the bivalent RNA scaffolds first using splitGFP complementation, which will enable us to test in high-throughput the hundreds of combinations of RNA scaffolds and RNA-binding proteins. To express the splitGFP-peptide fusions, we used Q5 site-directed mutagenesis to insert the short peptide sequences into the N terminus and C terminus for GFPA and GFPB (the two split haves of GFP). We then used sequencing to confirm correct assembly of all 20 new splitGFP-peptide plasmids.

Figure 5:
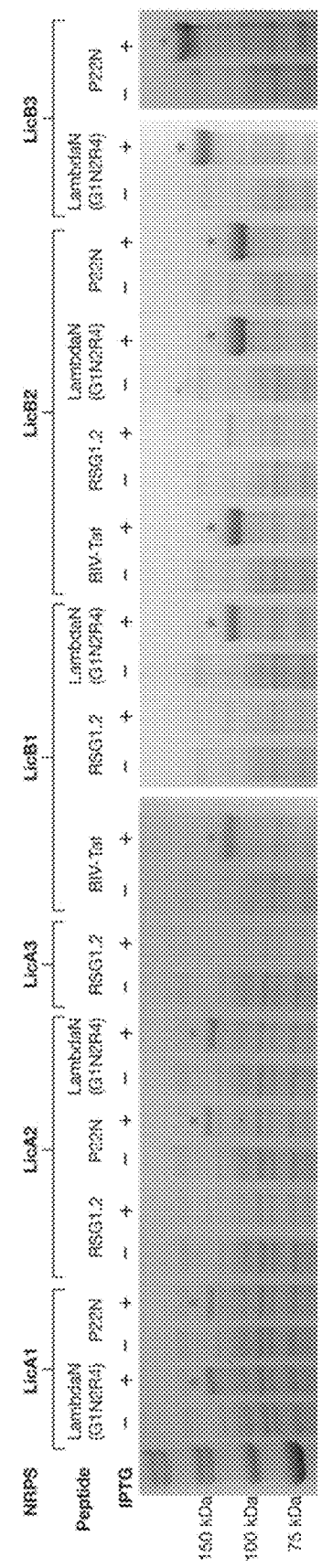
FIG. 5 demonstrates expression of NRPS modules with N-terminal RNA-binding peptide domains. Protein gel showing products obtained with and without induction by IPTG. Six NRPS modules were modified with different RNA-binding peptides. Out of 15 peptide-NRPS module fusions tested, 11 fusions as indicated by "*" were successfully expressed in E. coli.

Example 2—Generating Functional NRPSs after Incorporation of RNA-Binding Peptide Domains To generate NRPS modules that can bind to tRNA analogs, we have constructed plasmids for expressing six of the lichenysin NRPS modules (licA1, licA2, licA3, licB1, licB2, and licB3) fused to one of four potential RNA-binding peptides (LambdaN(G1N2R4), P22N, RSG1.2, and BIV-Tat). The peptides were inserted near the N-terminus of the NRPS module just after the His-purification tag based on our prior NRPS module structural analyses. Sequencing was used to confirm proper assembly of 15 of NRPS fusions and they were all tested for expression in *E. coli* BL21 Star DE3 using IPTG to induce transcription of the NRPS mRNA. Expression was carried out overnight at 18° C. to encourage proper fusion protein translation and folding. Uninduced controls lacking IPTG were also prepared for comparison. Following cell lysis and centrifugation to remove cell debris, the products remaining in the supernatant were characterized in protein gels (FIG. 5). We found that 11 out of the 15 NRPS fusions with RNA-binding peptides were successfully expressed by *E. coli* as indicated by the "*" in FIG. 5. The RNA-binding peptide RSG1.2 appears to inhibit translation of the NRPS module since all four fusions containing this peptide did not produce clear product bands on the protein gel.

Figure 6:
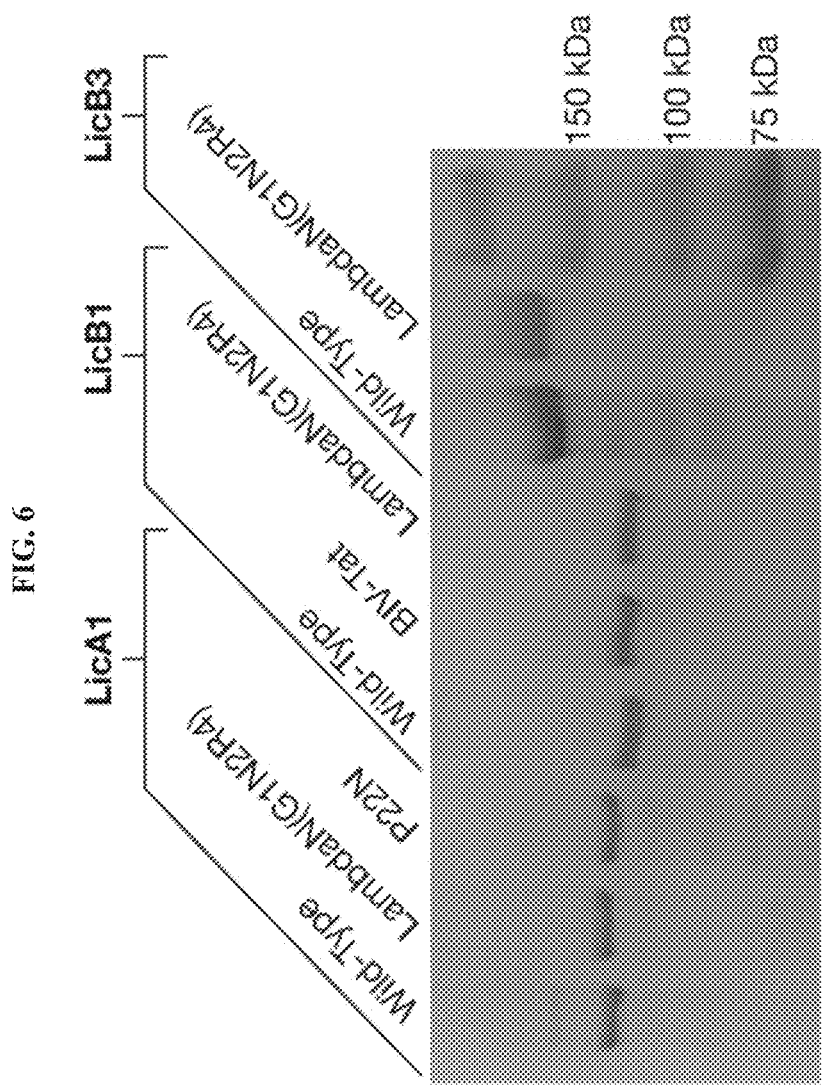
FIG. 6 demonstrates successful purification of NRPS modules with N-terminal RNA-binding peptide domains. His-tagged NRPS modules fused to RNA-binding peptide domains along with wild-type control lacking the peptide domain were purified on nickel columns. NRPS modules provided the expected molecular weights, with an observable shift to higher molecular weight for those NRPS modules with RNA-binding domains.

Five of the NRPS module fusions were then expressed and purified on nickel columns along with wild-type NRPS modules lacking the additional domains (FIG. 6). The resulting fusion proteins provide clear bands in gels and exhibit the expected increases in molecular weight following fusion to the RNA-binding peptide domains. The licB3 modules have a substantially higher molecular weight than licA1 and licB1 since licB3 has an additional epimerase domain for incorporating D-leucine into the resulting nonribosomal peptide.

Figure 7:
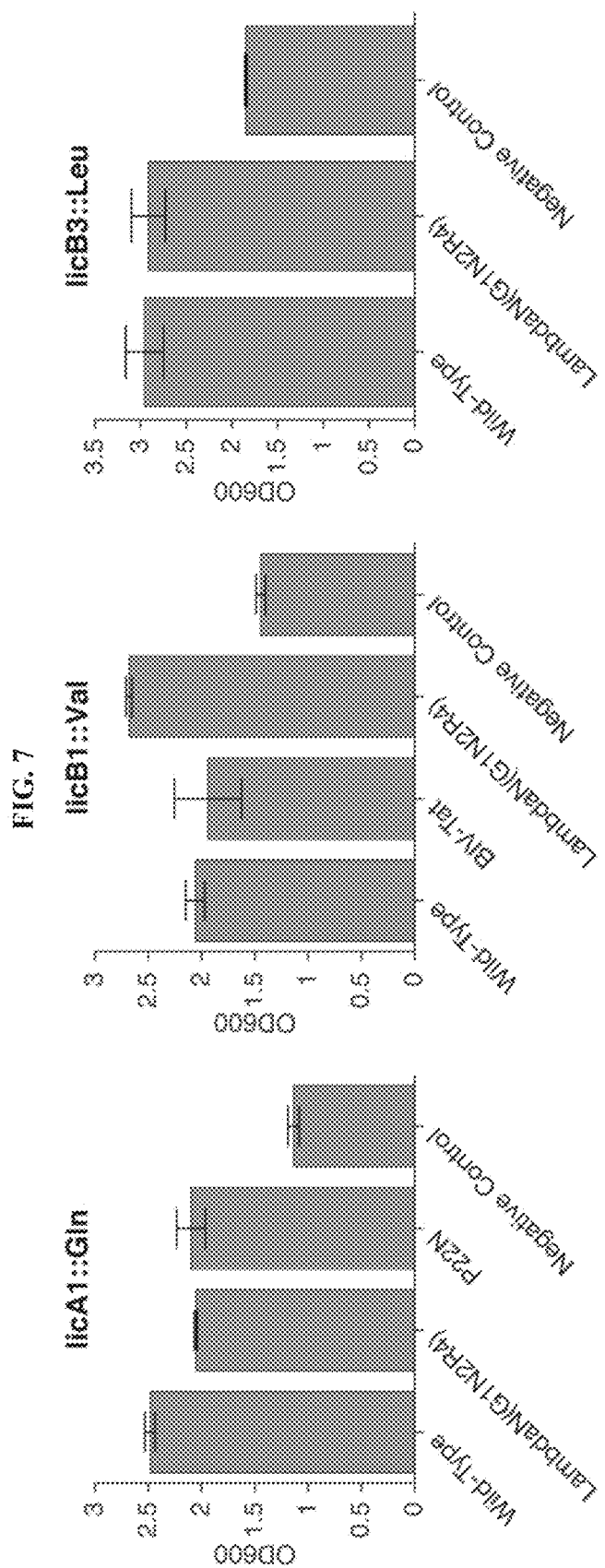
FIG. 7 demonstrates characterization of the adenylation activity of NRPS modules fused to RNA-binding peptide domains. LicA1, LicB1, and LicB3 all retained significant adenylation activity after addition of RNA-binding peptides to their N-termini as indicated by increased absorbance at 600 nm wavelength.

The five purified NRPS module fusions and the three wild-type enzymes were tested for adenylation activity using the malachite green and inorganic phosphatase assay of McQuade et al. (*Analytical Biochemistry* 386, 244 (2009)). The enzymes licA1, licB1, and licB3 were exposed to their corresponding amino acid substrates L-glutamine, L-valine, and D-leucine for three hours, respectively, while negative control reactions were run in the absence of the NRPS enzyme. These assays demonstrated that the NRPS module fusions retained significant adenylation activity even after the addition of the N-terminus peptide addition (FIG. 7). However, the level of activity did vary depending on the peptide added.

We also generated RevN7D-licC1, lambdaN-licA2, and HTLV-1-Rex-licA3 fusions and confirmed that these proteins retain their adenylation activity. NRPS initiation modules, which start nonribosomal peptide synthesis and lack condensation domains, are also being fused to RNA-binding peptide domains. The initiation modules will enable more efficient peptide synthesis once the NRPS assembly lines are constructed.

Example 3—Isolated NRPSs Retain Functionality after Loading onto a tRNA Analog

Gel-shift assays were performed to determine if the NRPS modules fused to RNA-binding peptides could successfully bind to their corresponding RNA aptamers. RNA transcripts bearing each aptamer were first prepared using in vitro transcription and column purified. The aptamer was then incubated with 4× excess of one of the three wild-type modules or five fusion modules for 40 minutes. The resulting products were then analyzed on 6% native PAGE RNA gels to assess the binding between RNA and enzyme.

Figure 8:
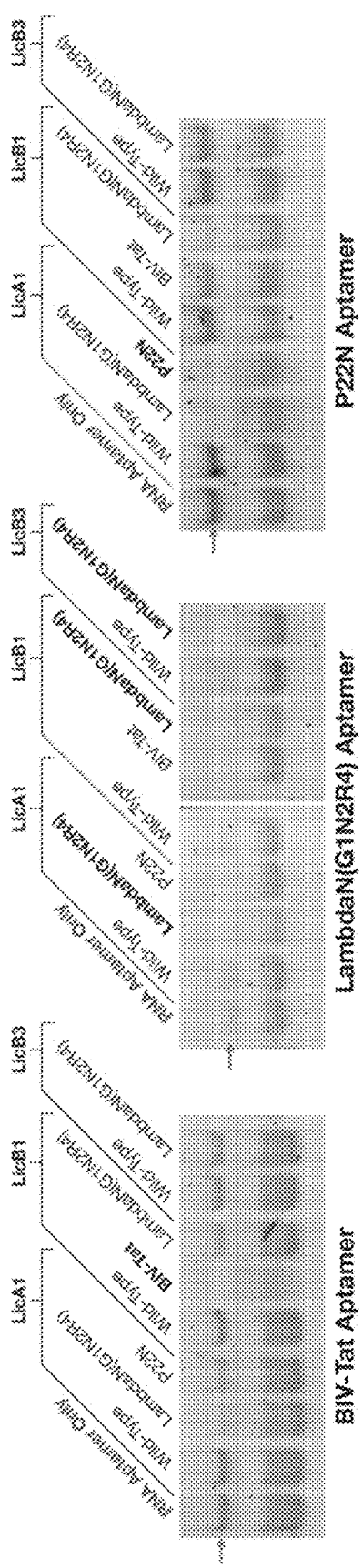
FIG. 8 presents a gel-shift assay for RNA aptamer interactions with NRPS module fusions with RNA-binding peptides. RNA molecules containing the cognate aptamers for the BIV-Tat, lambdaN(G1N2R4), and P22N RNA-binding peptides were exposed to different NRPS modules fused to RNA-binding peptides. Binding between RNA aptamer and fusion protein results in disappearance of the RNA band from PAGE gels. RNA aptamers do bind to their cognate peptide-NRPS fusions, with crosstalk observed in several cases. The main aptamer bands are indicated by arrows.

FIG. 8 shows three sets of experiments performed using the BIV-Tat, lambdaN(G1N2R4), and P22N aptamers. For the BIV-Tat aptamer, we observed substantial interaction between the BIV-Tat-licB1 fusion and the aptamer (FIG. 8, left). In particular, the primary aptamer band, as indicated by the arrow, nearly completely disappears upon exposure to the fusion protein since the high-molecular-weight fusion protein captures the aptamer and is unable to enter the 6% native PAGE gel. In contrast, RNA aptamer bands are observed for the other eight lanes, with some decrease in intensity for the lambdaN(G1N2R4)-licA1 fusion band suggesting some degree of cross-binding with the BIV-Tat aptamer. The gel for the lambdaN(G1N2R4) aptamer also provides evidence of binding between the aptamer at the lambdaN(G1N2R4)-NRPS module fusions. Although this aptamer does not stain effectively in this gel, the intensity of the aptamer in the lambdaN(G1N2R4) peptide bands does noticeably decrease compared to most of the non-cognate bands. The P22N-licA1 lane also shows a substantial decrease in intensity suggesting cross-reactivity. Lastly, the gel for the P22N aptamer indicates strong interactions between the aptamer and the P22N-licA1 fusion. Significant cross-interactions occur between the lambdaN(G1N2R4) fusions with licA1 and licB1.

Taken together, these results confirm that the RNA aptamers can interact with their corresponding peptides when the peptides are incorporated into functional NRPS modules. However, significant crosstalk was observed with both the lambdaN(G1N2R4) aptamer and peptide.

Figure 10:
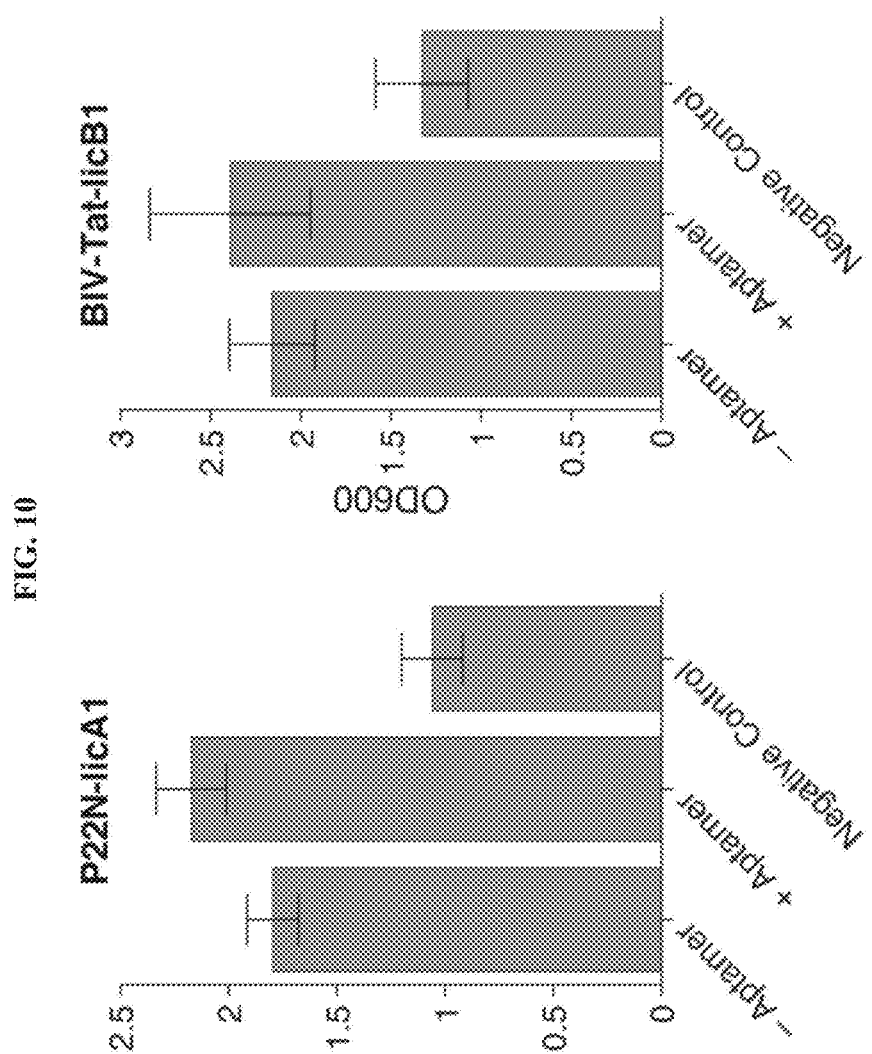
FIG. 10 shows adenylation activity of NRPS fusions. P22N-licA1 and BIV-Tat-licB1 were tested in the presence and absence of their cognate aptamers. Adenylation activity was not reduced by aptamer binding.

Using gel shift assays, we have identified a set of five NRPS-peptide fusions that bind to their corresponding RNA aptamers and do not show strong binding to non-cognate aptamers. The fusions are P22N-licA1, lambdaN-licA2, BIV-Tat-licB1, lambdaN(G1N2R4)-licB3, and RevN7D-licC1; and they incorporate L-glycine, L-leucine, L-valine, D-leucine, and L-isoleucine, respectively. Colorimetric assays have been used to measure the adenylation activity of two of these enzyme fusions when bound to their respective aptamer (FIG. 10). P22N-licA1 and BIV-Tat-licB1 exhibit similar or improved enzymatic activity when bound to aptamers compared to measurements in the absence of the RNA. We plan to test the adenylation activity of the remaining fusions from the orthogonal set in the next quarter. All of these enzymes have already been confirmed to exhibit adenylation activity in the absence of an aptamer.

Example 4—Generating NRPS Assembly Lines on a Single Multivalent RNA Scaffold

Experiments were performed to systematically study of the effects of changes to RNA scaffold geometry for a previously reported system employing the phage-derived MS2 and PP7 aptamers, which bind to known phage coat proteins.

Figures 9A, 9B:
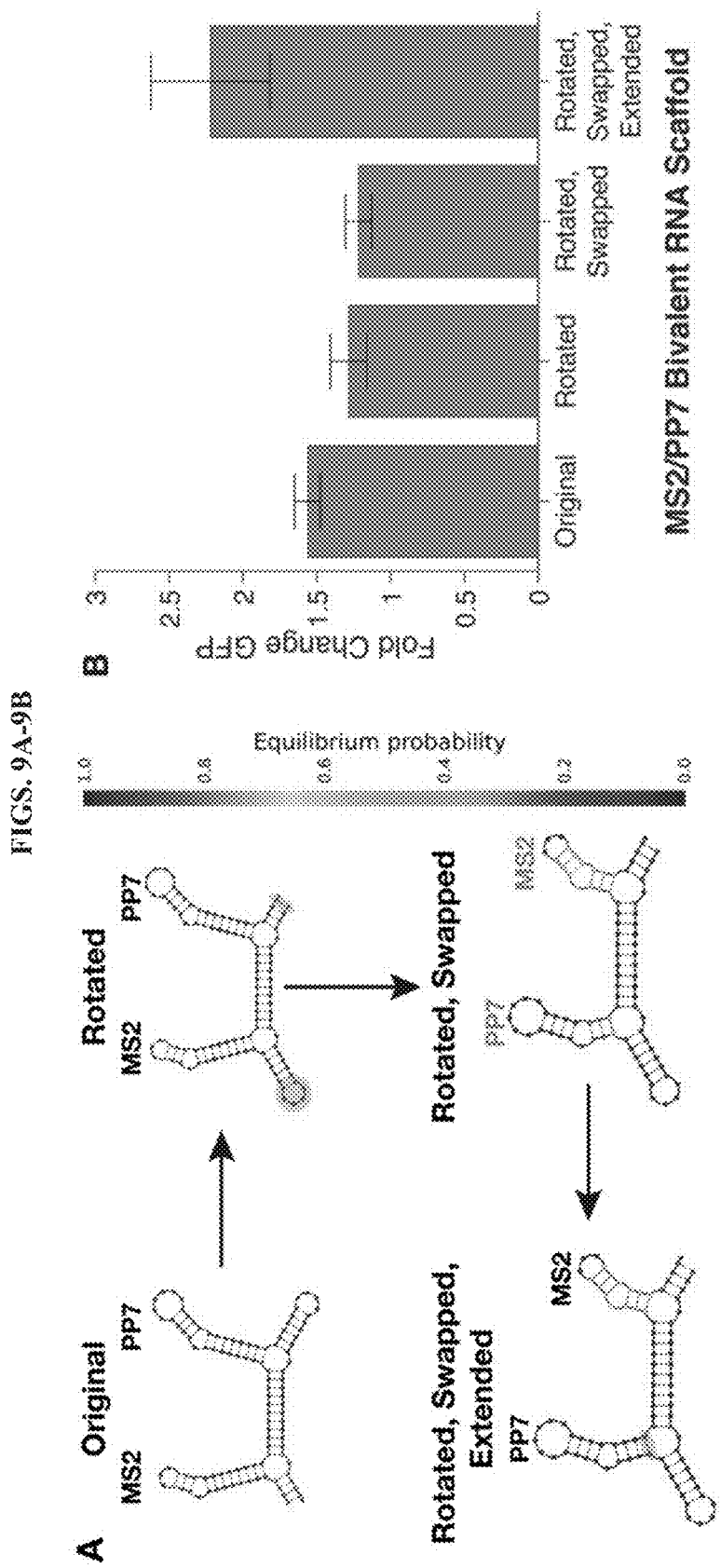
FIGS. 9A-9B demonstrate evaluation of splitGFP complementation in E. coli on different bivalent RNA scaffolds. A, Predicted RNA secondary structures for four different bivalent RNA scaffolds providing the MS2 and PP7 aptamers and subject to step-wise changes in geometry. Notable structural changes are highlighted in blue. B, Flow cytometry measurements of the change in GFP fluorescence intensity for the four bivalent RNA scaffolds shown in A compared to cells expressing splitGFP without an RNA scaffold. Despite the fairly small differences in RNA scaffold geometry, substantial changes in GFP fluorescence are observed.

We first took an RNA scaffold reported by Delebecque et al. (*Science* 333, 6041 (2011)) containing the aptamers MS2 and PP7 separated by an RNA duplex (FIG. 9A, "Original"). This scaffold is equivalent to the stiff bivalent RNA scaffolds described in Example 1. We also investigated three variants based on step-wise modifications to the original scaffold. The first variant is a cyclic permutation (i.e., a rotated version) in which the 5' and 3' ends are joined through a loop and the loop of the original is cut to form new 5' and 3' ends (marked by blue shading in FIG. 9A). The second variant was designed by taking the rotated version and swapping the positions of the PP7 and MS2 aptamers. To compensate for swapping positions, the aptamers were both rotated approximately 180° by removing 5 bp from their stems. Lastly, the fourth variant was generated simply by adding one extra base pair to the stem of the PP7 aptamer, which corresponds to a ~16° rotation and 0.26 nm increase in height.

The four different bivalent RNA scaffolds were expressed in *E. coli* BL21 Star DE3 along with GFPA-MS2 and PP7-GFPB fusions. Fluorescence from GFP was measured using flow cytometry three hours after induction with IPTG. For the first three RNA scaffolds, we observed increases in GFP fluorescence of between 1.2- and 1.6-fold with the rotated, swapped scaffold providing the lowest fluorescence out of the three. However, with the addition of a single base pair in the PP7 aptamer stem, the fourth RNA scaffold promoted a substantial increase in GFP fluorescence to 2.2-fold. Although the increase in GFP fluorescence that we observe with the RNA scaffolds is modest, the significant fluorescence changes that we observe for minute differences between scaffolds suggest that their geometries may need to be carefully fine-tuned. We expect that flexible scaffolds in which the aptamers are separated by single-stranded RNA rather than a duplex will display less sensitivity to structure. We are currently conducting experiments investigating these effects with other RNA scaffolds using MS2, PP7, and other aptamer/peptide pairs.

Figures 11A, 11B, 11C:
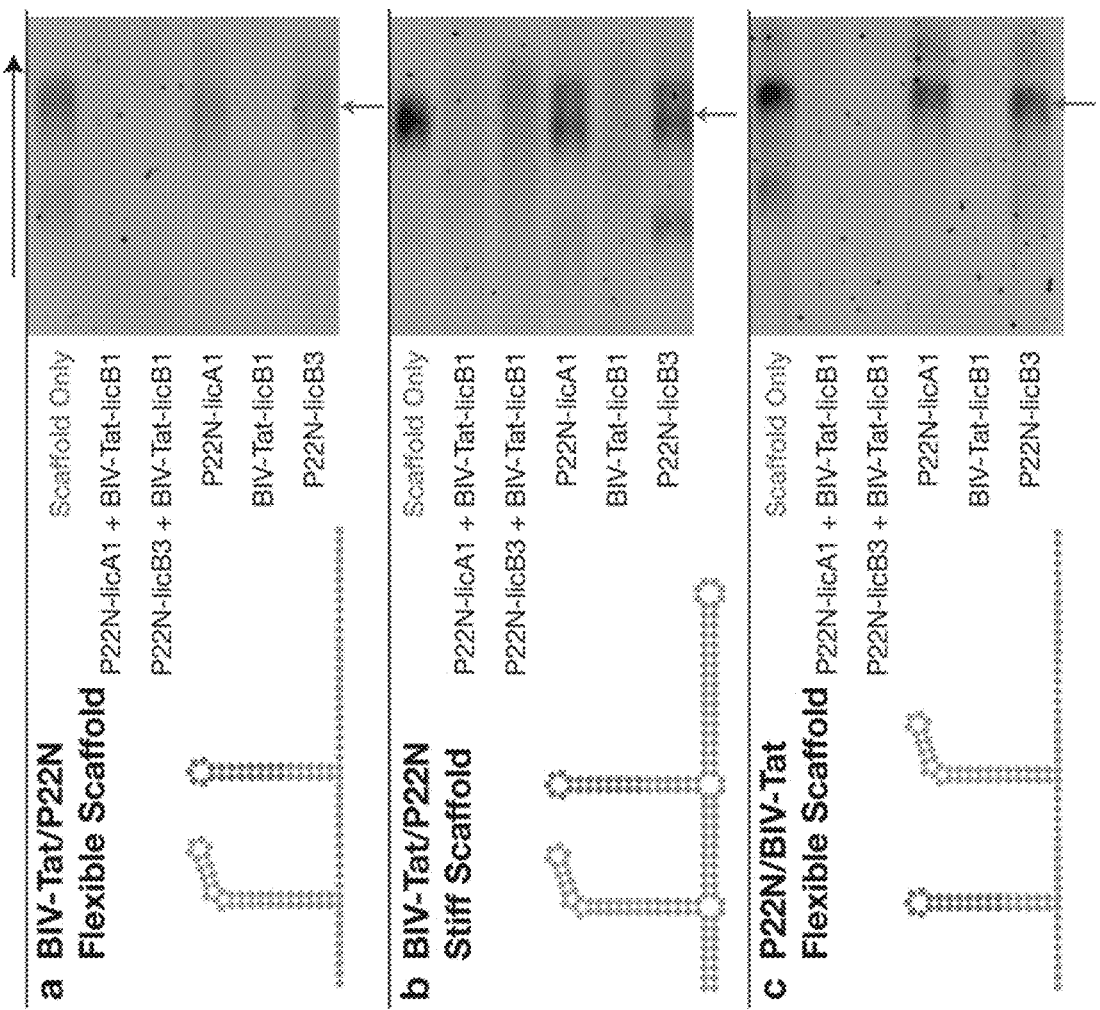
FIGS. 11A-11C demonstrate binding of NRPS fusions to bivalent single-strand RNA scaffolds. Gel shift assays for three bivalent RNA scaffolds containing the aptamers BIV-Tat and P22N: A, BIV-Tat/P22N flexible scaffold; B, BIV-Tat/P22N stiff scaffold; and C, P22N/BIV-Tat flexible scaffold. Arrows mark the band corresponding to the properly folded scaffold.

FIGS. 11A-11C show gel shift assays of three different scaffolds containing the aptamers BIV-Tat and P22N. These scaffolds all adopt 11-nt or 11-bp spacing between aptamer sites but vary in the flexibility and the ordering of the two aptamers. For all three scaffolds, the fusion BIV-Tat-licB1 displays high affinity for the RNA aptamer, causing the near complete disappearance of the main scaffold band. The P22N fusions show relatively weaker binding, but do noticeably reduce the intensity of the scaffold band. We previously observed this weaker binding for P22N fusions as compared to BIV-Tat fusions. The sole stiff scaffold, shown in FIG. 11B, displays an interesting increase in scaffold intensity when exposed to the fusions P22N-licB3 and BIV-Tat-licB1 compared to other lanes with BIV-Tat-licB1 present. This effect is not observed for the two flexible scaffolds (FIGS. 11A, 11C) and suggests that the nearby aptamer sites in the stiff scaffold may be interfering with one another to discourage enzyme binding. We speculate the effect is more pronounced when BIV-Tat-licB1 is paired with P22N-licB3, rather than P22N-licB1, because P22N-licB3 is a larger enzyme that contains an additional epimerase domain to incorporate D-leucine. To avoid these steric effects, we are currently testing scaffolds with larger spacing between aptamers.

We have also begun experiments to measure dipeptide formation from single-strand RNA scaffolds hosting two different NRPS fusions. Preliminary results showed differences in the chemicals detected in reactions with and without the RNA scaffolds but analysis of chromatograms produced from HPLC/MS of the reaction products is underway.

Example 5—Generating NRPS Assembly Lines on Co-Hybridizing tRNA Analogs

Scaffolding systems that employ co-hybridizing tRNA analogs provide a more modular method to assemble NRPS assembly lines. In these systems, each tRNA analog has an aptamer site for binding to a cognate NRPS-peptide fusion, along with two stem-loop arms used for hybridization to its nearest neighbor(s) in the line (FIG. 12A). To implement these tRNA analogs, we made use of two RNA structural motifs used in RNA nanotechnology. The first is a three-armed RNA junction geometry derived from bacteriophage packaging RNA (pRNA), which forms a T-shaped junction with a linear RNA duplex (illustrated by the blue strand in FIG. 12B). The second is the HIV kissing loop complex, which forms RNA stem loop assemblies with 180° junction angles (FIG. 12C). By combining both these motifs into the tRNA analog, we establish the RNA structure shown in FIG. 12D. In the structure, each tRNA has its own aptamer sequence and two tRNAs can hybridize to one another in 180° kissing loop junctions. Since the kissing loop is located on a coaxial arm taken from the pRNA structure, the tRNAs should form co-linear assemblies following the kissing loop interactions. Although FIG. 12D only shows a tRNA analog with one kissing loop sequence, it is important to note that kissing loops can be added to either stem-loop arm of the tRNA analog to enable binding to two nearest neighbors in the assembly line.

Figure 13:
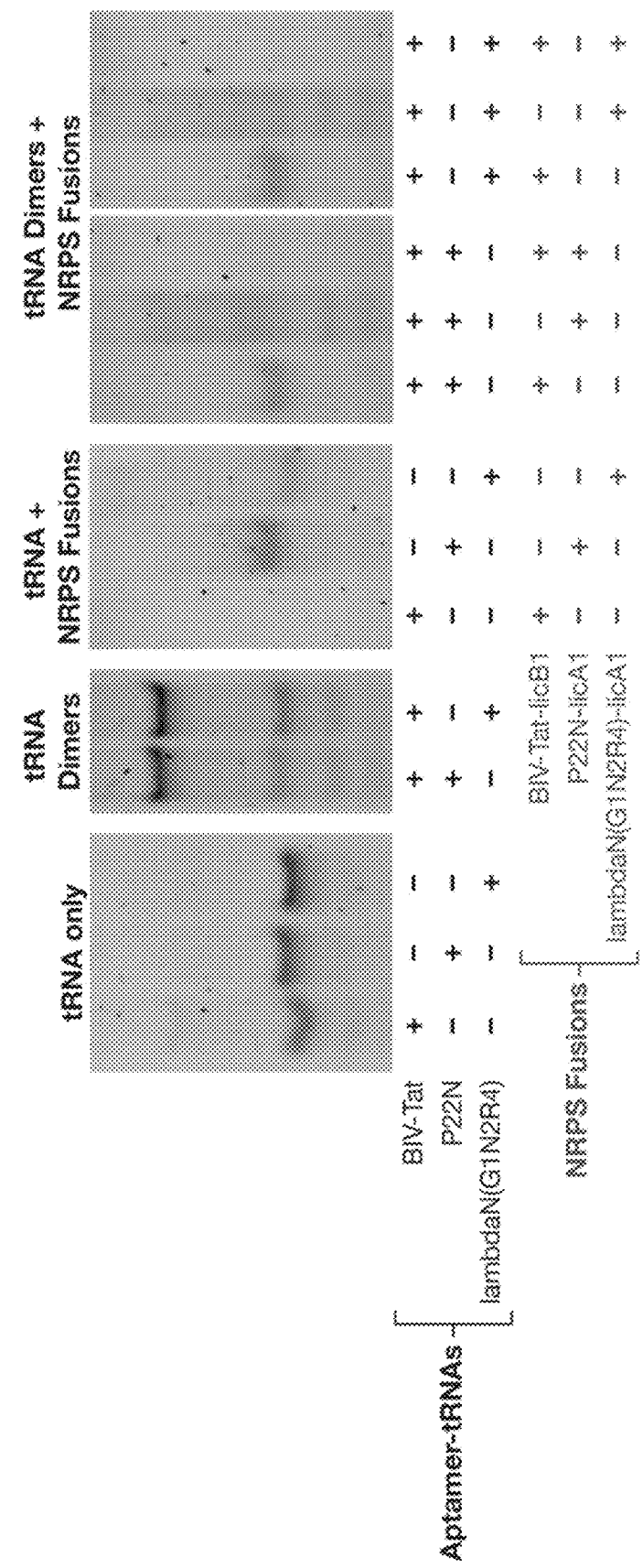
FIG. 13 demonstrates testing tRNA analog dimerization and binding to NRPS fusions. RNA gels showing the formation of tRNA dimers and gel shifts that occur when the tRNA analog is exposed to its cognate NRPS module fusion.

We designed tRNA scaffolds with the secondary structure shown in FIG. 12D and containing aptamers for peptide binding. A pair of tRNAs were designed for each aptamer to cover the complementary sequences of the HIV kissing loops. RNA gels were used to assess the dimerization of tRNA scaffolds and binding to NRPS fusions (FIG. 13). We found that the tRNAs readily formed dimers when tRNAs with complementary kissing loops were mixed together. These tRNAs employed the wild-type sequence from the HIV kissing loop. Furthermore, all three tRNA analogs clearly bound to their corresponding NRPS fusions and the tRNA dimers also successfully interacted with the fusions. Now that tRNA co-hybridization and module binding are confirmed, we plan to use HPLC/MS to determine if dipeptides can be formed using the enzyme assembly lines over the next quarter.

Figure 14:
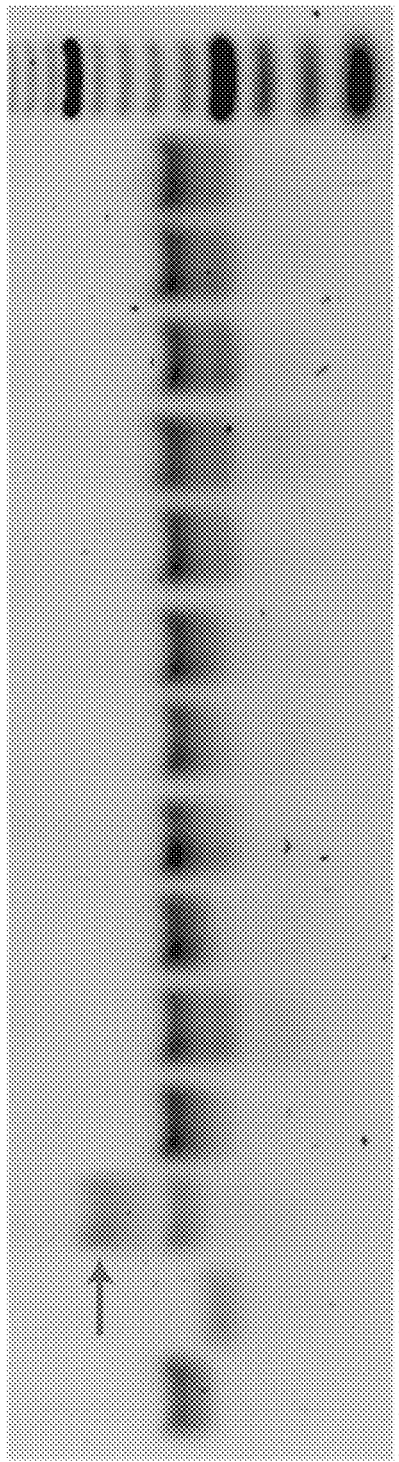
FIG. 14 demonstrates binding and orthogonality of RNA kissing loop complexes. Representative RNA gel showing a crosstalk test of a kissing loop RNA (1) with a set of 12 other kissing loop RNAs. Out of the 12 RNAs exposed to RNA 1, only the cognate RNA (1*) shows any binding with 1, which indicates that RNA 1 is very orthogonal.

Scale-up of co-hybridizing tRNA scaffolds requires the use of multiple orthogonal kissing loops to ensure that precise control of the sequence of NRPS modules in the assembly. We thus tested a library of 12 different kissing loop sequences, including the wild-type HIV sequence, to identify an initial set of orthogonal loop sequences. The kissing loop sequences were designed using NUPACK and screened to ensure that the six bases in the critical binding region of the loop had a GC content of at least 50%. We selected sequences with higher GC content since the wild-type HIV kissing loop sequence is GCGUGC, corresponding to a high GC content of 83%. The resulting kissing loop sequences were incorporated into RNA stem-loop secondary structures and assessed on RNA gels for binding against the rest of the kissing loops (FIG. 14). We found that nine out of the 12 kissing loop sequences successfully bound to one another at 37° C. The full set of sequences and their relative affinities for each other listed in Table 4. We found that none of the three kissing loops with GC content of 50% successfully hybridized to one another. At 66.7% GC content, binding was observed across all six sequences tested but with three displaying higher affinities than the others. Although measurements of orthogonality are ongoing, we currently have a set of four kissing loops that bind with high affinity and exhibit low crosstalk with one another. We expect that the size of this orthogonal library will increase as more kissing loop pairs are tested and with new sequences generated using a more stringent ≥66.7% GC condition for screening loop sequences.

TABLE 4

Kissing loop sequences tested for dimer formation

| Kissing Loop | Core Loop Sequence | GC Content (%) |
|---|---|---|
| 1 | GCGUGC | 83.3 |
| 2 | CUGUCG | 66.7 |
| 3 | GAGGUC | 66.7 |
| 4 | CGAUCA | 50 |
| 5 | *UGGUCG* | 66.7 |
| 6 | CUCAUC | 50 |
| 7 | GAGACC | 66.7 |
| 8 | *CGACUC* | 66.7 |
| 9 | GGUAGC | 66.7 |
| 10 | GUCAGA | 50 |
| 11 | *GAGCAC* | 66.7 |
| 12 | *UGACGG* | 66.7 |

Figure 15:
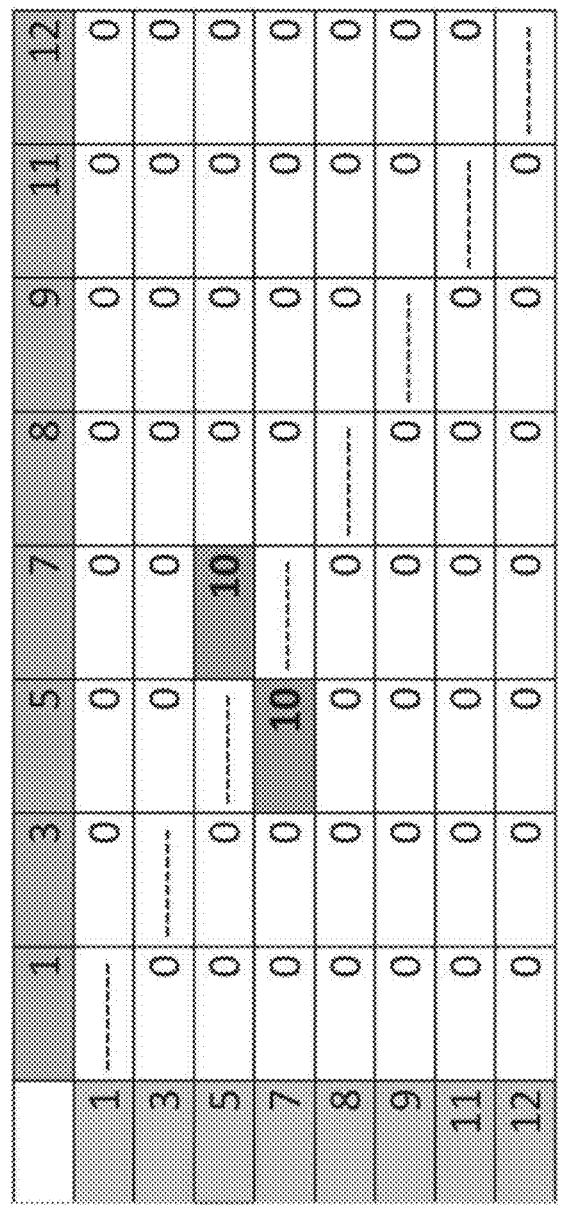
FIG. 15 demonstrates cross-reactivity of "norm" kissing loop sequences. Unwanted interactions were identified between loops 5 and 7. Only kissing loops that showed some affinity for their cognate "star" kissing loop were tested in these experiments.
Figure 16:
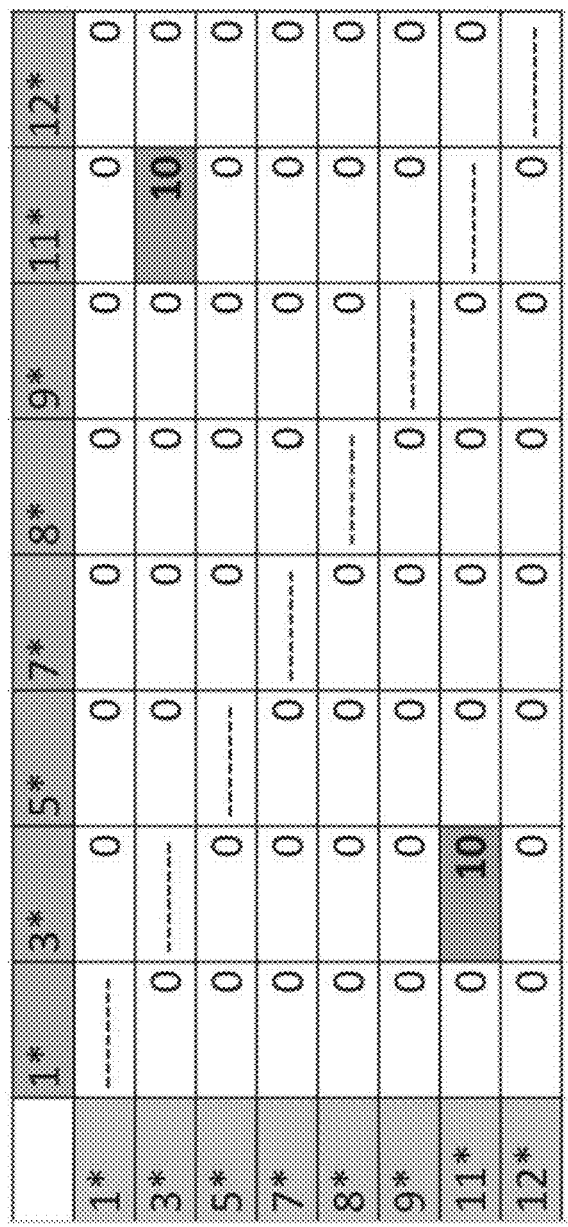
FIG. 16 demonstrates cross-reactivity of "star" kissing loop sequences. Unwanted interactions were identified between loops 3* and 10*.

Bold: loops with strong affinity and orthogonality
Italic: loops with intermediate affinity We used gel electrophoresis of 12 different kissing loop hairpins to determine which ones specifically interacted with their cognate partner and displayed little or no affinity for other kissing loop sequences. For instance, kissing loop 1 was tested against all 12 reverse complement kissing loops (e.g., 1*, 2*, etc.) comprising the "star" set, and it was tested against other kissing loops (e.g., 3, 5, 7, etc.) comprising the "norm" set. FIGS. 15-17 show the overall results of these studies. Two pairs of unwanted interactions were identified within the norm and star sets (FIGS. 15 and 16). However, we were able to confirm that four of the kissing loops—numbers 1, 3, 7, and 9 (bold in Table 4)—provided high binding affinity and were orthogonal to one another (FIG. 17). These four kissing loops feature very high GC content (≥66.7%) in the loop and suggest that screening a focused library containing only high GC content loops should yield an expanded library in the future.

We expanded the number of available peptide-NRPS modules by constructing ones based on two initiation modules: tycA1 (tyrocidine biosynthesis) and grsA1 (gramicidin S biosynthesis). These modules were used to generate eight tycA1 fusions to different peptides (BMVGag, BIV-Tat, RevN7D, LambdaN, LambdaN(G1N2R4), P22N, RevR11Q, HTLV-1 REX) and seven grsA1 fusions to different peptides (BMVGag, BIV-Tat, RevN7D, LambdaN, LambdaN(G1N2R4), RevR11Q, HTLV-1 REX). We focused on developing these initiation module fusions with the aim of improving the formation of dipeptides for HPLC/MS studies with co-hybridizing tRNA scaffolds.

In parallel, we isolated the three main modules for the bacillibactin biosynthesis operon. Bacillibactin is a siderophore synthesized by *Bacillus* strains that chelates iron and is thus capable of being detected using a simple colorimetric assay, rather than by mass spectroscopy. We plan to add RNA-binding peptide domains to these modules to reconstitute the biosynthesis complex and generate bacillibactin in vitro.

Figure 18:
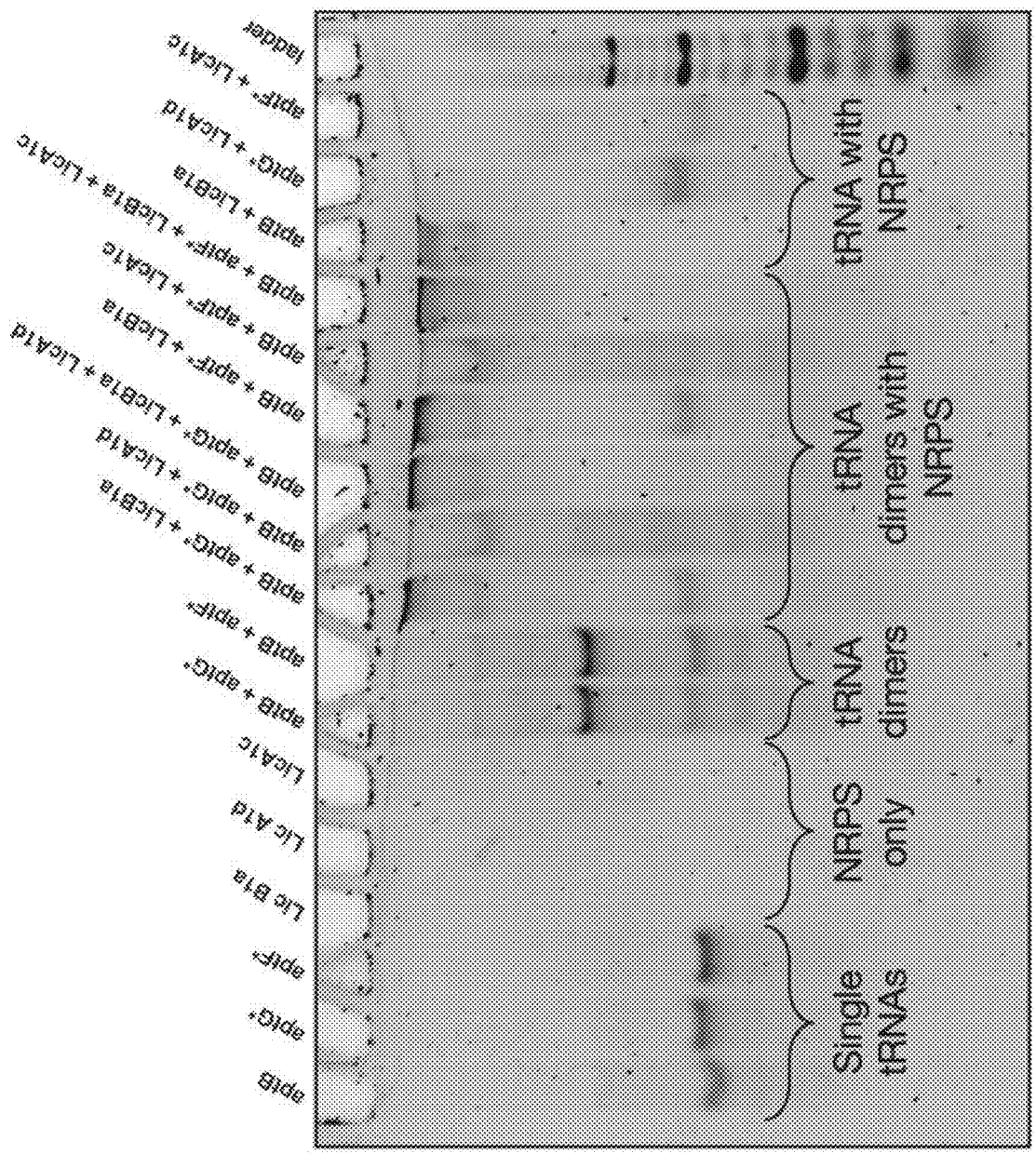
FIG. 18 presents gel electrophoresis studies of tRNA scaffold dimer formation and NRPS module binding. tRNA scaffolds containing three different aptamers and 1/1* kissing loop sequences were tested along with peptide-NRPS fusions from the lic operon. aptB=BIV_Tat aptamer with 1 kissing loop, aptG*=P22N aptamer with 1* kissing loop, and aptF*=lambda(G1N2R4) with 1* kissing loop. Peptides are designated by lowercase letters with a=BIV_tat, d=P22N, and c=lambda(G1N2R4). Thus, cognate pairs are aptB-LicB1a, aptG*-LicA1d, and aptF*-LicA1c.

We also evaluated binding between tRNA scaffolds containing different aptamer sites for NRPS module binding and having the most effective kissing loop sequence (1/1*) using gel shift assays. FIG. 18 shows RNA gel electrophoresis of different combinations of tRNAs and NRPS modules. In general, the tRNAs fold well and produce a single dominant band in the gel. Adding tRNAs with complementary kissing loop sequences leads to a significant gel shift that is indicative of tRNA dimer formation. Addition of the corresponding peptide-NRPS module leads to a large increase in apparent molecular weight with the bands shifting to the very top of the gel, indicating that the aptamer can be recognized by the peptide-NRPS. It is difficult to determine if the tRNA dimers can simultaneously bind to both peptide-NRPS modules based on the gel results. However, the gel shifts that occur for the tRNA dimers indicate that dimerization does not interfere with aptamer folding. Furthermore, the distance between aptamer sites can be tuned by extending the tRNA arms should steric effects discourage simultaneous binding of the two peptide-NRPS modules.

We then tested tRNA scaffolds containing different combinations of kissing loop sequences to determine if they could assemble into multimeric structures. These tRNAs have left and right arms that have different kissing loop sequences. In particular, the left arms can adopt kissing loop sequences 3, 7, or 9. The right arms can have the corresponding kissing loops 3*, 7*, or 9*. In addition, poly-T sequences can be used to designate tRNAs on the left or right ends of the complex, since the poly-T sequences are too weak to allow hybridization and discourage the formation of RNA aggregates in general.

Figure 19:
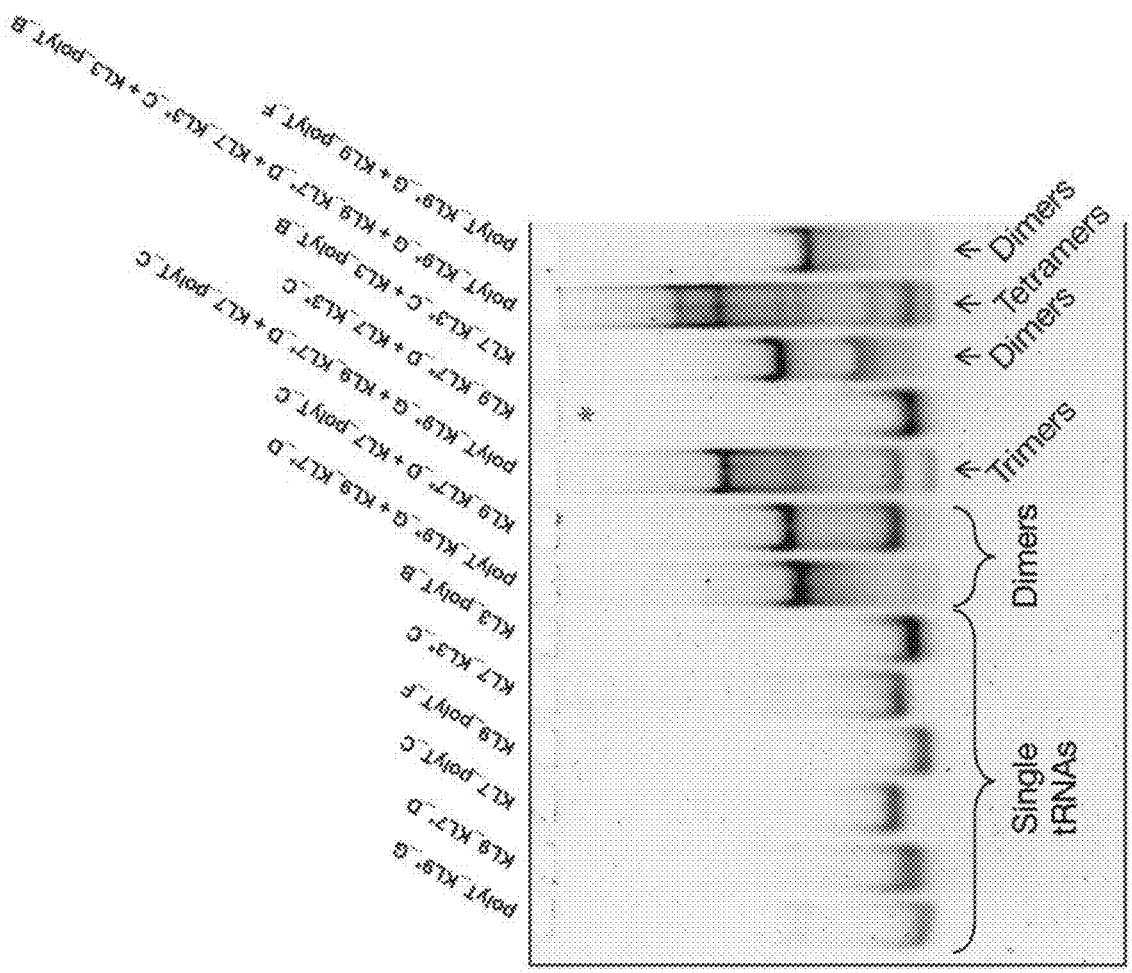
FIG. 19 presents gel electrophoresis studies of tRNA scaffold multimer formation. The tRNA scaffolds are labelled according to left and right kissing loops and their aptamer (e.g., tRNA with poly-T left arm, kissing loop 9* right arm, and aptamer G is labelled polyT_KL9*_G). Assembly of multimer complexes is observed with progressive increases in molecular weight. The largest complex consists of up to four tRNAs to form tetramers. Asterisk denotes a tRNA dimer that did not form as expected and is likely due to a pipetting error.

FIG. 19 shows a gel electrophoresis assay evaluating different tRNA assemblies. For all but one case, dimer structures between tRNAs with complementary kissing loops form as expected. We also observed formation of the trimer complex employing kissing loops 9/9* and 7/7*, which formed with approximately 50% yield. A four-tRNA complex exploiting kissing loops 9/9*, 7/7*, and 3/3* also formed, but with lower yields. Thus, it should be possible to form NRPS assembly lines of at least four modules using these tRNA analogs.

Figure 20:
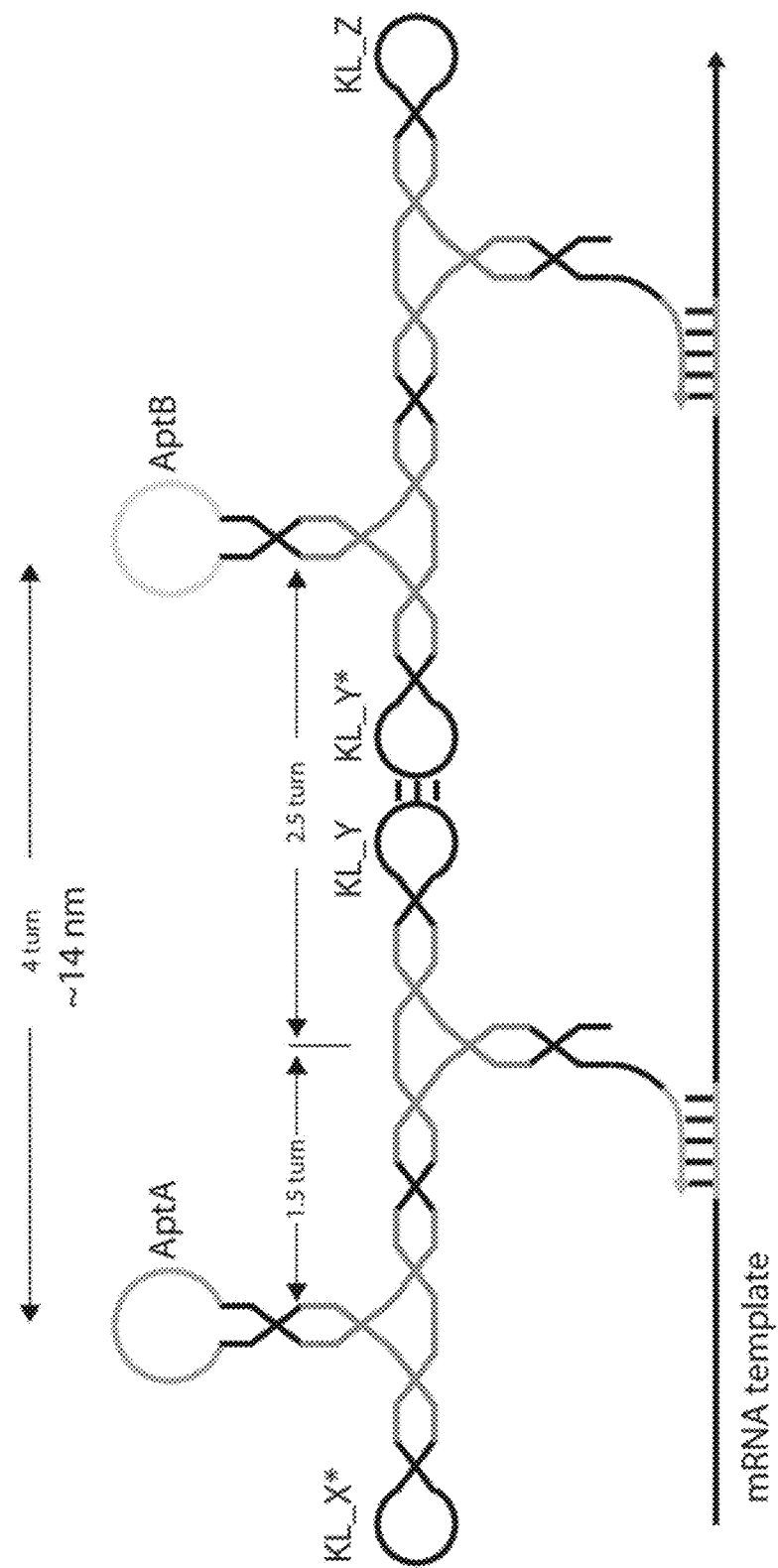
FIG. 20 is a schematic illustrating an exemplary design of an mRNA-templated tRNA analog system. The core pRNA structure is used to generate a central horizontal helix capped by kissing loop ends. Vertical helices separated by 1.5 turns point out in opposite directions to provide an aptamer for NRPS binding and an RNA sticky end for mRNA binding. Weak kissing loops are used to stabilize the assembled structure after mRNA templating, but will not cause tRNA co-hybridization in the absence of the mRNA.

To implement mRNA-templated systems, we have designed tRNA analogs based on the co-hybridizing ones described above that provide an RNA sticky end for mRNA binding and still allow proper positioning of the bound NRPS module. The general design of these tRNAs is shown in FIG. 20 and makes use of the same packaging RNA (pRNA) core employed by the previous tRNAs. A central horizontal RNA helix is used for positioning two kissing loop arms, while a pair of vertical helices are designed to extend from the central helix in opposite directions. The geometry of the central helix is taken from the pRNA core. The opposing directions of the two vertical helices are enforced by separating them by 1.5 turns of the central helix. The upward-directed vertical helix is used for the RNA aptamer available for binding to the NRPS. The downward-directed helix ends with a sticky end that can bind to the mRNA template. We have chosen to include hybridizing kissing loop domains in these systems as a means to control the relative positioning of the aptamer sites across the tRNAs since the mRNA will be quite flexible.

For initial evaluation of this design, we used a strong kissing loop sequence at one end of the horizontal helix to drive formation of a dimer structure with a tRNA scaffold having the complementary kissing loop. In tests with this initial system, we found that the two tRNAs can successful fold and hybridize with one another. We plan to continue testing these tRNAs using mRNA templates and will use weaker kissing loop sequences to ensure that the tRNAs do not spontaneously hybridize to one another in the absence of the mRNA template. Based on our studies of HIV kissing loop interactions, it should be possible to generate kissing loops with weak interactions that only occur after they are co-localized on the mRNA by using low GC content sequences.

SEQUENCE LISTING (90 sequences)

SEQ ID NO: 1 - DNA, 3264 bp, Artificial Sequence
  synthetic
atgttagcaaatcaggccaatctcatcgacaacaagcgggaactggagcagcatgcgctagttccatatgcacagggcaagtcgatccatcaattgttcgaggaacaagcagaggcttttccagaccgcgttgccatcgtttttgaaaacaggcggctttcgtatcaggagttgaacaggaaagccaatcaactggcaagagccttgctcgaaaaaggggtgcaaacagacagcatcgtcggtgtgatgatggagaagtccatcgaaaatgtcatcgcgattctggccgttcttaaagcaggcggagcctatgtgcccatcgacatcgaatatccccgcgatcgcatccaatatattttgcaggatagtcaaacgaaaatcgtgcttacccaaaaaagcgtcagccagctcgtgcatgacgtcgggtacagcggagaggtagttgtactcgacgaagaacagttggacgctcgcgagactgccaatctgcaccagcccagcaagcctacggatcttgcctatgtcatttacacctcaggcacgacaggcaagccaaaaggcaccatgcttgaacataaaggcatcgccaatttgcaatcctttttccaaaattcgtttggcgtcaccgagcaagacaggatcgggctttttgccagcatgtcgttcgacgcatccgtttgggaaatgttcatggctttgctgtctggcgccagcctgtacatcctttccaaacagacgatccatgatttcgctgcatttgaacactatttgagtgaaaatgaattgaccatcatcacactgccgccgacttatttgactcacctcaccccagagcgcatcacctcgctacgcatcatgattacggcaggatcagcttcctccgcacccttggtaaacaaatggaaagacaaactcaggtacataaatgcatacggcccgacggaaacgagcatttgcgcgacgatctgggaagccccgtccaatcagctctccgtgcaatcggttccgatcggcaaaccgattcaaaatacacatatttatatcgtcaatgaagacttgcagctactgccgactggcagcgaaggcgaattgtgcatcggcggagtcggcttggcaagaggctattggaatcggcccgacttgaccgcagaaaaattcgtagacaatccgttcgtaccaggcgaaaaaatgtaccgcacaggtgacttggccaaatggctgacggatggaacgatcgagtttctcggcagaatcgaccatcaggtgaaaatcagaggtcatcgcatcgagcttggcgaaatcgagtctgttttgttggcacatgaacacatcacagaggccgtggtcattgccagagaggatcaacacgcgggacagtatttgtgcgcctattatatttcgcaacaagaagcaactcctgcgcagctcagagactacgccgcccagaagcttccggcttacatgctgccatcttatttcgtcaagctggacaaaatgccgcttacgccaaatgacaagatcgaccgcaaagcgttgcccgagcctgatcttacggcaaaccaaagccaggctgcctaccatcctccgagaaccgagacagaatcgattctcgtctccatctggcaaaacgttttgggaattgaaaagatcgggattcgcgataatttttactcgctcggcggagattcgatccaagcgatccaggtcgtggctcgtctgcattcctatcaattgaagctagagacgaaagacttgctgaattacccgacgatcgagcaggttgctctttttgtcaagagcacgacgagaaaaagcgatcagggcatcatcgctggaaacgtaccgcttacacccattcagaagtggtttttcgggaaaaactttacgaatacaggccattggaaccaatcgtctgtgctctatcgcccggaaggctttgatcctaaagtcatccaaagtgtcatggacaaaatcatcgaacaccacgacgcgctccgcatggtctatcagcacgaaaacggaaatgtcgttcagcacaaccgcggcttgggtggacaattatacgatttcttctcttataatctgaccgcgcaaccagacgtccagcaggcgatcgaagcagagacgcaacgtctgcacagcagcatgaatttgcaggaaggacctctggtgaaggttgccttatttcagacgttacatggcgatcatttgtttctcgcaattcatcatttggtcgtggatggcatttcctggcgcattttgtttgaagatttggcaaccggatacgcgcaggcacttgcagggcaagcgatcagtctgcccgaaaaaacggattcttttcaaagctggtcacaatggttgcaagaatatgcgaacgaggcggatttgctgagcgagattccgtactgggagagtctcgaatcgcaagcaaaaaatgtgtccctgccgaaagactatgaagtgaccgactgcaaacaaaagagcgtgcgaaacatgcggatacggctgcacccggaagagaccgagcagttgttgaagcacgccaatcaggcctatcaaacggaaatcaacgatctgttgttggcggcgctcggcttggcttttgcggagtggagcaagcttgcgcaaatcgtcattcatttggaggggcacgggcgcgaggacatcatcgaacaggcaaacgtggccagaacggtcggatggtttacgtcgcaatatccggtattgctcgacttgaagcaaaccgctcccttgtccgactatatcaagctcaccaaagagaatatgcggaagattcctcgtaaagggatcggttacgacatcttgaagcatgtgacacttccagaaaatcgcggttccttatccttccgcgtgcagccggaagtgacgttcaactacttgggacagtttgatgcggacatgagaacggaactgtttacccgctcaccctacagcggcggcaacacgttaggcgcagatggcaaaaacaatctgagtcctgagtcagaggtgtacaccgctttgaatataaccggattgattgaaggcggagagctcgtcctcacattctcttacagctcggagcagtatcgggaagagtccatccagcaattgagccaaagttatcaaaagcatctgcttgccatcatcgcgcattgcaccgagaaaaaagaagtagagcgaacgcccagcgatttcagcgtcaaaggtctccaaatggaagaaatggacgatatcttcgaattgcttgcaaatacactgcgc

SEQ ID NO: 2 - protein, 1088 aa, Artificial Sequence
  synthetic
MLANQANLIDNKRELEQHALVPYAQGKSIHQLFEEQAEAFPDRVAIVFENRRLSYQELNRKANQLARALLEKGVQTDSIVGVMMEKSIENVIAILAVLKAGGAYVPIDIEYPRDRIQYILQDSQTKIVLTQKSVSQLVHDVGYSGEVVVLDEEQLDARETANLHQPSKPTDLAYVIYTSGTTGKPKGTMLEHKGIANLQSFFQNSFGVTEQDRIGLFASMSFDASVWEMFMALLSGASLYILSKQTIHDFAAFEHYLSENELTIITLPPTYLTHLTPERITSLRIMITAGSASSAPLVNKWKDKLRYINAYGPTETSICATIWEAPSNQLSVQSVPIGKPIQNTHIYIVNEDLQLLPTGSEGELCIGGVGLARGYWNRPDLTAEKFVDNPFVPGEKMYRTGDLAKWLTDGTIEFLGRIDHQVKIRGHRIELGEIESVLLAHEHITEAVVIAREDQHAGQYLCAYYISQQEATPAQLRDYAAQKLPAYMLPSYFVKLDKMPLTPNDKIDRKALPEPDLTANQSQAAYHPPRTETESILVSIWQNVLGIEKIGIRDNFYSLGGDSIQAIQVVARLHSYQLKLETKDLLNYPTIEQVALFVKSTTRKSDQGIIAGNVPLTPIQKWFFGKNFTNTGHWNQSSVLYRPEGFDPKVIQSVMDKIIEHHDALRMVYQHENGNVVQHNRGLGGQLYDFFSYNLTAQPDVQQAIEAETQRLHSSMNLQEGPLVKVALFQTLHGDHLFLAIHHLVVDGISWRILFEDLATGYAQALAGQAISLPEKTDSFQSWSQWLQEYANEADLLSEIPYWESLESQAKNVSLPKDYEVTDCKQKSVRNMRIRLHPEETEQLLKHANQAYQTEINDLLLAALGLAFAEWSKLAQIVIHLEGHGREDIIEQANVARTVGWFTSQYPVLLDLKQTAPLSDYIKLTKENMRKIPRKGIGYDILKHVTLPENRGSLSFRVQPEVTFNYLGQFDADMRTELFTRSPYSGGNTLGADGKNNLSPESEVYTALNITGLIEGGELVLTFSYSSEQYREESIQQLSQSYQKHLLAIIAHCTEKKEVERTPSDFSVKGLQMEEMDDIFELLANTLR

SEQ ID NO: 3 - DNA, 3186 bp, Artificial Sequence
  synthetic
atgagtgtatttagcaaagaacaagttcaggatatgtatgcgttgaccccgatgcaagaggggatgctgtttcacgccttgctcgatcaagagcacaactcgcatctggtacagatgtcgatttcgttgcagggcgatcttgacgttgggctatttacggatagcctgcatgtgctggtagagagatacgatgtattccgcacgttgtttctctatgaaaagctgaagcagcctttgcaagttgtcttgaagcaacggcctattccgatcgaattttacgacttgtctgcctgcgacgagtccgagaaacaacttcgctatacgcaatacaaaagggcggatcaggagcggacgtttcatctggcaaaagacccgttgatgcgggtcgcccttttccaaatgtcccagcacgactaccaggtcatctggagctttcatcacatcctcatggacggctggtgcttcagcattatttttgatgacttgcttgccatctacttgtccttgcaaaacaagacggcactctccctggagcccgtacagccatacagtcgctttatcaactggctggaaaaacaaaataaacaggccgctctcaactattggagcgactatctggaagcctatgaacaaaagactaccttgccgaagaaggaagctgccttcgccaaagcatttcaaccaacccaataccgcttttcgctgaaccgcaccttgaccaagcagctcgggaccatcgccagtcaaaatcaagtgacgctatcgacggtgattcaaacgatctggggagttctcctgcaaaaatacaatgcggcccatgatgtgctgttcggctctgttgtatccggacgccctacagacatcgtcggaatcgacaaaatggttggcttgtttatcaatacgattccattccgggtgcaagcgaaagctggtcaaacgttttccgagctgttgcaagctgtgcacaaaagaactttgcaatcacagccgtatgagcacgtgcctttgtacgacattcaaactcagtccgtcttgaagcaggagctgattgaccacctgctggtcatcgaaaattacccgctggtagaggctttgcagaaaaaagcattgaaccagcagatcggcttcacgattactgctgtggaaatgttcgagccgaccaattacgacttgactgtcatggtgatgccaaaagaagagcttgccttccgttttgactacaatgcggctctgtttgacgaacaggtcgtgcaaaaactggcggggcacctccaacagatcgcggattgcgtggcaaacaattcgggagtcgagctttgccagattccgttgctgacagaagcagaaactagccagctgttggcaaagcgtacggaaacagcggctgactatcctgccgcaaccatgcacgagctgttttcgcggcaggcagaaaaaacgcctgagcaagtggcggtagtcttcgcggatcagcacctgacgtatcgggagctggatgaaaaatccaatcagctcgcccgctttttgcgcaaaaaaggcattggcacgggcagtcttgtcggcacgctgctggatcgctcgctggacatgatcgtcggaatcctcggcgtcttgaaggcaggcggcgcatttgtgccgatcgacccggagttgcctgccgaacgaatcgcttacatgctgacgcatagcagagttccattggtcgtgacgcaaaatcatttgcgggcaaaagtgaccacgcctacagaaacaattgacatcaacacagcggtgatcggggaagagagccgcgcccctatcgaatcgctcaatcagccgcatgacttgttttacatcatctatacgtccggaacgacagggcaaccgaaaggcgtcatgctggagcatcgcaacatggcgaacctgatgcattttacgtttgatcagacgaacatcgcttttcatgaaaaagtgttgcagtataccacgtgcagctttgatgtttgctaccaggaaattttctccacgctgctatccgggggccagctctacctgatcacgaacgagctgagacggcatgtggaaaagctgtttgctttcatccaggaaaagcagatcagcattttgtctctcccggtgtccttcctgaaatttatttttaacgaacaagactacgcgcaaagcttcccgcgttgtgtcaaacatatcatcacggccggggaacaactcgtcgtcacacacgagctgcaaaagtatctgcgccagcatcgcgtatttttgcacaatcactacggcccgtcggagacgcatgtggtgacgacatgcacgatggacccgggacaggcgataccagagctgccgcccatcggaaagccgatcagcaacacaggcatttacattttggatgaagggctgcaattgaagccggaggggatcgtcggggagttgtacatttccggcgcaaacgtaggaagagggtatttgcaccagccggagctgaccgcggagaagtttctcgacaatccgtatcagccaggcgaaagaatgtaccgaacgggtgatctggccctttggttgccggatggccagctcgaatttttgggccgaatcgaccatcaggtaaaaatcaggggccatcgcatcgagctgggagagatcgaatcgcgcctgctcaaccatcccgccatcaaggaagcggtggttatcgaccgagcagacgagacaggcggcaagtttttgtgcgcctatgtcgtcctgcaaaaagcgctcagcgacgaagagatgcgggcatacttggcgcaagcgttgccggagtatatgatcccttcctttttcgtgacgctggagcggattccagtcacgccgaacggaaaaacagacaggcgagctttgccgaagccggaaggaagtgccaagacgaaagcggattacgtcgccccgacgactgagctggaacaaaagctggtcgcgatttgggagcaaattcttggcgtgtcgccgatcggcattcaggatcattttttcacgctgggcggccattcgttaaaagcgattcagctcatttcccgcatccaaaaggaatgccaggcggatgtcccgctgcgcgtcctgtttgagcaaccgacgattcaagcgctggcagcgtatgtggaaggcggggaggaaagcgcgtatctcgccattccccaggccgagccgcaagcgtat

SEQ ID NO: 4 - protein, 1062 aa, Artificial Sequence
  synthetic
MSVFSKEQVQDMYALTPMQEGMLFHALLDQEHNSHLVQMSISLQGDLDVGLFTDSLHVLVERYDVFRTLFLYEKLKQPLQVVLKQRPIPIEFYDLSACDESEKQLRYTQYKRADQERTFHLAKDPLMRVALFQMSQHDYQVIWSFHHILMDGWCFSIIFDDLLAIYLSLQNKTALSLEPVQPYSRFINWLEKQNKQAALNYWSDYLEAYEQKTTLPKKEAAFAKAFQPTQYRFSLNRTLTKQLGTIASQNQVTLSTVIQTIWGVLLQKYNAAHDVLFGSVVSGRPTDIVGIDKMVGLFINTIPFRVQAKAGQTFSELLQAVHKRTLQSQPYEHVPLYDIQTQSVLKQELIDHLLVIENYPLVEALQKKALNQQIGFTITAVEMFEPTNYDLTVMVMPKEELAFRFDYNAALFDEQVVQKLAGHLQQIADCVANNSGVELCQIPLLTEAETSQLLAKRTETAADYPAATMHELFSRQAEKTPEQVAVVFADQHLTYRELDEKSNQLARFLRKKGIGTGSLVGTLLDRSLDMIVGILGVLKAGGAFVPIDPELPAERIAYMLTHSRVPLVVTQNHLRAKVTTPTETIDINTAVIGEESRAPIESLNQPHDLFYIIYTSGTTGQPKGVMLEHRNMANLMHFTFDQTNIAFHEKVLQYTTCSFDVCYQEIFSTLLSGGQLYLITNELRRHVEKLFAFIQEKQISILSLPVSFLKFIFNEQDYAQSFPRCVKHIITAGEQLVVTHELQKYLRQHRVFLHNHYGPSETHVVTTCTMDPGQAIPELPPIGKPISNTGIYILDEGLQLKPEGIVGELYISGANVGRGYLHQPELTAEKFLDNPYQPGERMYRTGDLALWLPDGQLEFLGRIDHQVKIRGHRIELGEIESRLLNHPAIKEAVVIDRADETGGKFLCAYVVLQKALSDEEMRAYLAQALPEYMIPSFFVTLERIPVTPNGKTDRRALPKPEGSAKTKADYVAPTTELEQKLVAIWEQILGVSPIGIQDHFFTLGGHSLKAIQLISRIQKECQADVPLRVLFEQPTIQALAAYVEGGEESAYLAIPQAEPQAY

SEQ ID NO: 5 - DNA, 3195 bp, Artificial Sequence
  synthetic
caaccgacgattcaagcgctggcagcgtatgtggaaggcggggaggaaagcgcgtatctcgccattccccaggccgagccgcaagcgtattatcccgtatcgtctgcgcaaaaacgcatgctcatcttaaaccagctcgatccgcacagcacggtttacaacctgcctgtcgcgatgatcctcgaaggaacgctggataaagctcggctggagcacgccatttccaacctggtggctcgccatgagtcgttgcgcacgtcgtttcatacgatcaacggggagccagtttcccgcatccatgagcaaggccacttgccgattgtttacttggaaacggcggaagagcaagtgaacgaggtcattttggggttcatgcagccgtttgatctggtaacagctccgctatgccgggttggcttggtgaagctcgcagagaaccgtcacgtcctgatcatcgacatgcaccatatcatttcggacggagtctcttctcagctcatcctgaatgacttttcccgtttgtatcaaaacaaagctttgccagagcagcgcattcactataaagacttcgccgtttgggaaaaagcgtggacacaaacgaccgattaccaaaaacaggaaaaatattggctcgatcgatttgcgggcgaaatcccggttttgaacctgccgatggattacccgcggccagctgttcaaagctttgagggcgaacgttatttgttccgcacagaaaaacagttgttggaaagtttgcaggacgtagcccaaaagacaggcacgaccttgtacatggtgcttctcgcagcctatcatgtgctgctttccaaatactccgggcaggatgacgtgatgatcggcaccgtgactgccggcagggtgcacccggatacggagagcatgacggggatgttcgtcaacacgctggcgatgcgcaatcagtctgcgccgaccaaaacgttccggcaatttttgctggaggtaaaagacaacacgctggccgcttttgaacacgggcaatatccgtttgaagagcttgtcgaaaagttggcgatccagcgaaaccggagccgaaacccgctgttcgacaccttgttcattttgcaaaacatggatgccgacctgatcgagctggatggactgaccgtgacgccttatgtgccagagggggaagtcgccaagttcgatctgtcgctggaagcaagcgaaaaccaggcgggactttccttctgcttcgaattttgcaccaagctgttcgcacgcgagacgatcgagcgcatgtcgcttcattacttgcaaattttgcaggcagtcagcgcaaacacggagcaggagctggcgcaaatcgagatgctgactgcgcatgagaagcaggagctgctcgttcacttcaacgacacggccgccctgtatccagcggagagcacgctgtcgcagctgtttgaagatcaggcacagaaaactcctgagcaaaccgccgtcgtcttcggtgacaaacgactgacgtaccgcgaactgaacgagcgggccaaccagctcgcgcacactttgcgggcaaaaggcgtgcaggctgagcaaagcgtagggatcatggcgcaaagatcgttggaaatggcgatcggaattatcgctattctcaaagcgggcggggcgtatgtgccgatcgatccggattatccgaatgagcggattgcttacatgctggaagattgccgccgtctggtgctgacccagcagcagctcgccgaaaagatgaccgcaaacgtggaatgcctgtatctggatgaggagggcagctactcgcctcagacggaaaacatcgagccgatccataccgctgctgatctcgcttacatcatctacacatccggtacgacaggcaggccaaaaggcgtcatggtagagcatcggggaatcgtcaacagtgtgacgtggaacagggacgagtttgccctttctgtccgggacagtggaacgctgtcgctatcttttgccttcgatgcctttgcccttactttctttacgttgattgtatcaggctccacggtcgtcctgatgccggatcacgaagccaaagatccgatcgcgctacgcaacctgattgccgcttgggaatgcagctacgtcgttttcgtgcccagtatgttccaggcgatattggagtgcagcactccggcagacatccgctccatccaggcagtcatgctcgggggcgaaaagctgtcgccgaagcttgttcagctgtgcaaagcgatgcatccgcagatgagcgtgatgaatgcatacggcccgacggagagcagcgtcatggccacctacctgcgagatacacagccagatcagccgatcaccatcgggcggccgattgccaacaccgccatttacatcgtagaccagcaccatcaactgctgcctgtcggggtggtaggggaaatctgcatcggcggtcacggcttggcgcggggctattggaaaaagccggagcttactgcggagaaattcgtggccaatccagctgttccgggagagcgcatgtacaaaacaggcgatctgggcagatggctccacgacggcacgattgattttataggccgcgtcgatgaccaaatcaaggtgagaggataccggattgaggtcggggagattgaagcggttttgctcgcttacgatcagacgaatgaagctatcgtcgtcgcttatcaggacgatcgcggcgattcctatctggctgcgtatgtcacgggaaaaacggcgatagaggaatccgagcttcgcgcgcatctgttgcgagagcttccggcctacatggtgccgacctacctgattcaactggacgctttcccgctcacgccaaacggcaaggtcgaccgcaaggcactgcccaagccggaaggaaagcctgcaacaggagcagcttatgtcgcacccgctacagaagtggaggcgaagctggtcgccatttgggagaatgcgctggggatttccggcgtcggggtgttggatcacttttttgagctgggcggtcattccttgaaagcgatgacggttgtggcgcaagtgcatcgcgagtttcaaatcgaccttttgctgaagcagttttttgcagcgccaaccatccgggacttggcccgcttgatcgaacatagcgaacaggcagccggcgccgccattcaaccggcagagccgcaagcgtat

SEQ ID NO: 6 - protein, 1065 aa, Artificial Sequence
  synthetic
QPTIQALAAYVEGGEESAYLAIPQAEPQAYYPVSSAQKRMLILNQLDPHSTVYNLPVAMILEGTLDKARLEHAISNLVARHESLRTSFHTINGEPVSRIHEQGHLPIVYLETAEEQVNEVILGFMQPFDLVTAPLCRVGLVKLAENRHVLIIDMHHIISDGVSSQLILNDFSRLYQNKALPEQRIHYKDFAVWEKAWTQTTDYQKQEKYWLDRFAGEIPVLNLPMDYPRPAVQSFEGERYLFRTEKQLLESLQDVAQKTGTTLYMVLLAAYHVLLSKYSGQDDVMIGTVTAGRVHPDTESMTGMFVNTLAMRNQSAPTKTFRQFLLEVKDNTLAAFEHGQYPFEELVEKLAIQRNRSRNPLFDTLFILQNMDADLIELDGLTVTPYVPEGEVAKFDLSLEASENQAGLSFCFEFCTKLFARETIERMSLHYLQILQAVSANTEQELAQIEMLTAHEKQELLVHFNDTAALYPAESTLSQLFEDQAQKTPEQTAVVFGDKRLTYRELNERANQLAHTLRAKGVQAEQSVGIMAQRSLEMAIGIIAILKAGGAYVPIDPDYPNERIAYMLEDCRRLVLTQQQLAEKMTANVECLYLDEEGSYSPQTENIEPIHTAADLAYIIYTSGTTGRPKGVMVEHRGIVNSVTWNRDEFALSVRDSGTLSLSFAFDAFALTFFTLIVSGSTVVLMPDHEAKDPIALRNLIAAWECSYVVFVPSMFQAILECSTPADIRSIQAVMLGGEKLSPKLVQLCKAMHPQMSVMNAYGPTESSVMATYLRDTQPDQPITIGRPIANTAIYIVDQHHQLLPVGVVGEICIGGHGLARGYWKKPELTAEKFVANPAVPGERMYKTGDLGRWLHDGTIDFIGRVDDQIKVRGYRIEVGEIEAVLLAYDQTNEAIVVAYQDDRGDSYLAAYVTGKTAIEESELRAHLLRELPAYMVPTYLIQLDAFPLTPNGKVDRKALPKPEGKPATGAAYVAPATEVEAKLVAIWENALGISGVGVLDHFFELGGHSLKAMTVVAQVHREFQIDLLLKQFFAAPTIRDLARLIEHSEQAAGAAIQPAEPQAY

SEQ ID NO: 7 - DNA, 4560 bp, Artificial Sequence
  synthetic
gcgccaaccatccgggacttggcccgcttgatcgaacatagcgaacaggcagccggcgccgccattcaaccggcagagccgcaagcgtattatccggtatcttctgctcagcagcggatgtacttgctccatcagcttgaaggtgccggaatcagctacaacacaccgggcatcatcatgctggaaggcaagctcgatcgcgagcaattggcgaatgcgctgcaagcgttggtagatcgtcacgatattttgcggacgtcttttgagatggtcggagacgagctggtgcaaaaaattcatgaccgcgtggccgtgaacatggagtatgtgacggcagaagagcagcagatcgatgaccttttccacgcgttcgtccgtccgtttgatctttctgtgccgccattgctccgcatgagcctggtgaaactcgcggatgagcgtcacctgctcctgtacgacatgcaccatattgctgccgatgccgcatcgatcacgatcctgttcgatgaactggctgaattgtaccagggaagagaactgccggaaatgcgcatccagtacaaagattttgctgtctggcaaaaagccttgcatgagtcggatgccttcaagcagcaggaagcgtattggctgagcacgttcgctggaaatatcaccgctgtcgatgtgccgacagattttccgcgcccagccgtgaaaagttttgcaggggggcaagtcaccctgtccatggaccaagagctgctcagtgctttgcacgagttggctgcgcatacgaatacgacgctgtttatggttttgctggccgcctacaacgtgctgctcgcaaaatacgctgggcaagacgacatcatcgtgggaacgccgatctccggcaggtcacgcgccgagcttgcgcctgtcgtcggcatgttcgtccatacgctggcgatccgcaacaaaccgaccgccgagaagacattcaagcagtttttgcaggaggtcaagcaaaacgcgctcgatgctttcgaccaccaggactacccgtttgaaagccttgtggaaaagctgggcattccgcgcgatccggggcgcaatccgctgtttgacaccatgttcatcctgcaaaacgatgagttgcacgcaaaaacgctggatcagctcgtctatcgcccttatgaatcggacagcgcgcttgacgtggcgaaattcgacttgtcgttccatctgaccgagcgggaaaccgacctgttcttgcgcctggaatactgcaccaagctgttcaagcaacaaacggtagaacgaatggcgcaccacttcttgcaaattttgcgagcggtcacggccaatccggaaaatgaattgcaagagatcgagatgctgacagcagcagaaaagcaaatgctgctggtggcgttcaacgatacgcacagagaataccgggcagatcaaacaatccagcaactttttgaagagctggcggaaaaaatgcctgagcacacggcgctcgtattcgaagaaaagcgcatgtcgttccgggagctgaatgaaagagcgaaccagctcgcagccgttttgcgggaaaaaggagtcgggccagcgcagatcgtcgctttgctggtagagcgttccgccgagatggtcattgccacgcttgccacgttaaaagcgggcggcgcctttttgcccgtcgatcctgattatccggaagagcgaatccgctacatgctggaggacagccaggcaaaactggtggtgacccatgcgcacttgctgcacaaagtgagcagtcagtccgaagtcgttgatgtggatgaccctggaagctacgcaacacagacagacaacctgccgtgcgcaaacacaccgtctgatttggcttatatcatttacacgtccggtacgacgggcaagccaaaaggcgtcatgctggagcacaaaggggtagcgaatctgcaagcggtatttgcccatcatctaggcgtcacgccgcaagatcgggcagggcattttgccagcatctcgtttgacgcatcggtgtgggatatgtttggcccgttgctgtcgggagcgaccttgtacgtcttgtcccgagacgtcatcaacgattttcaacgattcgccgaatacgttcgcgataacgcgatcaccttcctcactttgccgccgacgtacgcgatttatctggagccggagcaggtgccgtcgttacgcaccctgattacagccggatcggcttcctccgttgcattggtggataaatggaaagaaaaagtcacctatgtcaatggatacggcccaacagagagcaccgtttgcgcgacactgtggaaagccaaaccggatgagccagtcgaaacgatcacgattggcaaaccgattcagaacaccaagctgtacatcgtggatgaccagttgcagttgaaagcgccggggcagatgggagaactgtgcatcagcggcttgtcgctggcgagaggctattggaatcgtccagagctgaccgccgagaagttcgtcgacaacccgtttgtgccaggaacaaagatgtaccggacaggcgacctggcaagatggctgccagatggaactatcgagtatctgggcagaatcgatcaccaagtgaaaattcgcggacatcgtgtggaactcggcgaagtggaaagcgtgctgctgcggtatgacacggtcaaagaggcagctgccatcacacatgaggacgaccgcggccaagcttacttgtgcgcctactacgtagcggagggagaagccacgcctgcgcaacttcgagcctatatggaaaacgagttgccgaactacatggttcccgccttctttatccagttggaaaagatgccgctgacaccgaatgacaagattgaccgaaaagcgctgccgaagccgaaccaggaggagaaccggactgagcaatatgcagcgccgcaaaccgagctggaacagttgctggctggcatctgggcagatgtactggggatcaagcaagtcgggacgcaagacaacttctttgaattgggcggcgattcgattaaagcgatccaggtatccacccgcctgaatgcgtcaggctggacgcttgcgatgaaagaactgttccagtacccgacgattgaagaagctgctctgcgcgtcatcccgaacagccgagagagcgagcagggtgtcgtagaaggcgagattgccttgacaccgatccagaaatggttcttcgcgaacaacttcacggatcgtcaccattggaatcaggctgtcatgctgtttcgcgaggacggctttgacgagggactcgtgcggcaagcgttccagcaaatcgtcgagcatcacgatgcgctgcgcatggtctacaagcaagaggacggggcgatcaagcaaatcaaccgcgggctgaccgacgagcgcttccgtttctactcttatgacttgaaaaatcacgcgaacagcgaagctcgcatcctggagctgtctgatcagatccagagcagcatcgatttggagcacggcccactcgttcacgtggctctgttcgccacaaaagacggggatcatttgctggtcgcgatccaccatcttgtcgtggatggcgtctcctggcgcattttgttcgaagatttttcctcagcctactcgcaggctctccatcagcaggagatcgtcttgccgaaaaagacggactccttcaaagactgggcggctcaattgcaaaagtacgcggacagcgacgagctgttgcgggaagtggcatattggcacaacttggagactacaacgacgactgcggcactgccaacagattttgtcacggcagatcgcaagcaaaaacatacgcggacactgtcgttcgcgttgacagtcccgcagacagaaaaccttttgcgtcacgttcatcatgcctatcacacagagatgaacgacctgctgctgacagcgctcggcttggccgtaaaagactgggcacatacgaatggcgtcgtcatcaatctggaaggccatgggcgcgaagacatccagaacgaaatgaacgtcacgcgcacgattggctggttcacttcgcaatatccggtggtgctcgacatggaaaaagccgaggacttgccgtaccagatcaagcaaaccaaagaaaacttgcgacggattccgaaaaaagggatcggctacgagattttgcgcacgctgacgacaagccagttgcagccgccattagcctttacgctgcggccggaaatcagctttaactatctcggtcaattcgagtcggacggaaaaacaggcgggtttacattctcgccgctcggaacagggcagttgttcagcccggaatcggagcgagtgttcctgctggacatttccgccatgatcgaggacggcgagctgcggatcagcgtggggtacagccgtctccaatatgaggaaaaaacgattgccagcctggcagacagctaccggaagcacttgctaggcatcatcgagcattgcatggcaaaagaagaaggcgagtacaccccgagcgacctgggggatgaagagctgtccatggaggagctggaaaacatcctggaatggatt

SEQ ID NO: 8 - protein, 1520 aa, Artificial Sequence
  synthetic
APTIRDLARLIEHSEQAAGAAIQPAEPQAYYPVSSAQQRMYLLHQLEGAGISYNTPGIIMLEGKLDREQLANALQALVDRHDILRTSFEMVGDELVQKIHDRVAVNMEYVTAEEQQIDDLFHAFVRPFDLSVPPLLRMSLVKLADERHLLLYDMHHIAADAASITILFDELAELYQGRELPEMRIQYKDFAVWQKALHESDAFKQQEAYWLSTFAGNITAVDVPTDFPRPAVKSFAGGQVTLSMDQELLSALHELAAHTNTTLFMVLLAAYNVLLAKYAGQDDIIVGTPISGRSRAELAPVVGMFVHTLAIRNKPTAEKTFKQFLQEVKQNALDAFDHQDYPFESLVEKLGIPRDPGRNPLFDTMFILQNDELHAKTLDQLVYRPYESDSALDVAKFDLSFHLTERETDLFLRLEYCTKLFKQQTVERMAHHFLQILRAVTANPENELQEIEMLTAAEKQMLLVAFNDTHREYRADQTIQQLFEELAEKMPEHTALVFEEKRMSFRELNERANQLAAVLREKGVGPAQIVALLVERSAEMVIATLATLKAGGAFLPVDPDYPEERIRYMLEDSQAKLVVTHAHLLHKVSSQSEVVDVDDPGSYATQTDNLPCANTPSDLAYIIYTSGTTGKPKGVMLEHKGVANLQAVFAHHLGVTPQDRAGHFASISFDASVWDMFGPLLSGATLYVLSRDVINDFQRFAEYVRDNAITFLTLPPTYAIYLEPEQVPSLRTLITAGSASSVALVDKWKEKVTYVNGYGPTESTVCATLWKAKPDEPVETITIGKPIQNTKLYIVDDQLQLKAPGQMGELCISGLSLARGYWNRPELTAEKFVDNPFVPGTKMYRTGDLARWLPDGTIEYLGRIDHQVKIRGHRVELGEVESVLLRYDTVKEAAAITHEDDRGQAYLCAYYVAEGEATPAQLRAYMENELPNYMVPAFFIQLEKMPLTPNDKIDRKALPKPNQEENRTEQYAAPQTELEQLLAGIWADVLGIKQVGTQDNFFELGGDSIKAIQVSTRLNASGWTLAMKELFQYPTIEEAALRVIPNSRESEQGVVEGEIALTPIQKWFFANNFTDRHHWNQAVMLFREDGFDEGLVRQAFQQIVEHHDALRMVYKQEDGAIKQINRGLTDERFRFYSYDLKNHANSEARILELSDQIQSSIDLEHGPLVHVALFATKDGDHLLVAIHHLVVDGVSWRILFEDFSSAYSQALHQQEIVLPKKTDSFKDWAAQLQKYADSDELLREVAYWHNLETTTTTAALPTDFVTADRKQKHTRTLSFALTVPQTENLLRHVHHAYHTEMNDLLLTALGLAVKDWAHTNGVVINLEGHGREDIQNEMNVTRTIGWFTSQYPVVLDMEKAEDLPYQIKQTKENLRRIPKKGIGYEILRTLTTSQLQPPLAFTLRPEISFNYLGQFESDGKTGGFTFSPLGTGQLFSPESERVFLLDISAMIEDGELRISVGYSRLQYEEKTIASLADSYRKHLLGIIEHCMAKEEGEYTPSDLGDEELSMEELENILEWI

SEQ ID NO: 9 - DNA, 3156 bp, Artificial Sequence
  synthetic
atgaaaaagcaggaaaacatcgcaaaaatttacccgctaaccccattgcaagagggtatgttgtttcacgctgtcacagacacgggcagcagcgcctattgcctccagatgtctgcaacgatcgagggcgattttcacctgccgctttttgaaaagagtctgaacaagctcgtggaaaactacgaagtattgcgcacggcttttgtataccaaaacatgcagcgacctcgccaagtcgtgttcaaggaaagaaaagtgaccgttccttgcgaaaacatcgcgcatttgccaagcgcagagcaggacgcgtacatacaagcgtacacgaagcaacatcatgcattcgacctgacaaaagacaacttgatgaaagcagccatttttcaaacggccgagaacaagtaccgattggtttgggccttccatcatattatcgtggacggttggacattgggcgtcttgctgcataagctgctgacctattacgcagcgctgcgaaaaggcgagccgattccgcgggaagcgacgaagccgtacagcgaatatatcaagtggctggataagcaaaacaaggacgaggccctcgcttattggcaaaactacctggcagggtatgaccatcaggctgcttttccgaaaaagaagcttggaacggaagcaagccgctatgaacatgtcgaggcgatgttcacgatcgctcccgagaagacgcagcagctgatccagatcgcgaaccaaaatcaggcgacgatgagcagcgtgtttcaagctctttggggcattttggccagcacatacaaaaatgcggacgatgtcgttttcggctcggtcgtatcaggccgcccgccgcaaatccaaggaattgagagcatggtcggcttgttcatcaacacgattccgacccgcgtccagacgaacaaacaacagacgttcagcgagctgctgcaaaccgtgcaaaagcaagccctggcgtctgccacctacgatttcgcgccgctgtacgaaattcagagcacaacagtgctgaaacaggaattgatcgatcatttggtcacgtttgaaaattaccccgatcattcgatgaagcatctggaagaatcattagggtttcaattcaccgtagaaagcggagatgagcagacctcctatgatttgaacgtggtcgtcgccctcgctccctcgaacgagctgtacgtgaagctaagctacaatgccgcggtgtatgaatcgtcattcgtaaacagaatcgaagggcatctccgcaccgtcatcgaccaggtgatcggcaatccgcatgtacacctgcacgagatcggcatcatcaccgaagaggaaaagcagcaactgctcgtcgcctacaacgacacggctgctgaatatccgcgggacaaaacgattttcgagctgatcgcggaacaagcgagccggacaccagcgaaagcagcagttgtttgcggcgaggacaccctgacctatcaggagctgatggagcgttctgcccagcttgccaatgctttgcgcgaaaaaggaatcgccagcggcagcatcgtctcgattatggcggaacattcactggagctgatcgtggcgatcatggctgtcttgcggtcaggtgctgcctacttgccgattgatcccgagtacccgcaagatcgcatccagtatttgctcgatgacagccagaccacgctgctgttaacccagtcgcatctgcaaccaaacatccggtttgcaggcagcgtgctttatttggacgatcgttccttgtacgaaggcggcagcacatccttcgcacccgagagcaagcctgatgatttggcgtacatgatctacacttccggttctaccggcaatccaaaaggggcgatgattactcatcaaggcctggtcaattacatctggtgggccaacaaggtgtacgtccaaggcgaagcggtggactttccgctgtactcatctatttcgttcgatttgaccgtcacctcgatcttcacgccgcttctgtccggcaacacgattcatgtgtacagaggggcagacaaggtacaggtcattttggacatcatcaaagataacaaagtcgggatcatcaagctgacgccgacacacctgaagctgattgaacacatcgacggcaaggccagcagcatcagacggttcatcgtcggcggcgagaacttgccgacaaagctggcgaagcaaatatacgaccatttcggagagaacgtgcaaattttcaacgagtacggaccgaccgaaaccgttgtcggttgcatgatttacttgtatgacccgcaaacaacgacccaggagtcggtgccaatcggtgtcccggcagacaacgtccagctttatttgctcgatgcttccatgcagccggtgcccgtcggctcgcttggcgaaatgtacatagccggagacggcgtagccaaagggtatttcaacagaccggagctgacgaaggaaaagtttatcgacaacccgttccgtccgggaaccaaaatgtatcgaacaggcgacctggcaaaatggctgcctgatggaaacatggagtatgcaggcagaatggactatcaagtgaagattcgcggccatcggatcgagatgggcgaaatcgaaacgcgcctgacgcagcatgaggcggtcaaggaagcggtcgtgatcgtggaaaaggatgagagcggccaaaacgtgttgtacgcgtaccttgtttccgagcgggaactgacggtagctgagctgagagaatttttggggcgcacgctgccttcctatatgattccttccttctttattcgcttggcggaaattccgctgaccgcgaacggaaaagtagagcgaaaaaaattgccgaagccagctggcgcagtcgttacaggcaccgcgtatgcagctccgcaaaatgaaatcgaggcaaagctggccgagatatggcagcaagtgctgggcataagccaggtagggattcacgacgatttctttgacttgggcggacactcgttgaaggcgatgactgtcgttttccaagtctcgaaagcgctggaagtggaattgcccgtaaaggccttgttcgaacatccaaccgttgcggagctggcccgcttcctttcgcggtcggaaaaaaccgagtacaccgcgattcaacccgtggcagcg

SEQ ID NO: 10 - protein, 1052 aa, Artificial Sequence
  synthetic
MKKQENIAKIYPLTPLQEGMLFHAVTDTGSSAYCLQMSATIEGDFHLPLFEKSLNKLVENYEVLRTAFVYQNMQRPRQVVFKERKVTVPCENIAHLPSAEQDAYIQAYTKQHHAFDLTKDNLMKAAIFQTAENKYRLVWAFHHIIVDGWTLGVLLHKLLTYYAALRKGEPIPREATKPYSEYIKWLDKQNKDEALAYWQNYLAGYDHQAAFPKKKLGTEASRYEHVEAMFTIAPEKTQQLIQIANQNQATMSSVFQALWGILASTYKNADDVVFGSVVSGRPPQIQGIESMVGLFINTIPTRVQTNKQQTFSELLQTVQKQALASATYDFAPLYEIQSTTVLKQELIDHLVTFENYPDHSMKHLEESLGFQFTVESGDEQTSYDLNVVVALAPSNELYVKLSYNAAVYESSFVNRIEGHLRTVIDQVIGNPHVHLHEIGIITEEEKQQLLVAYNDTAAEYPRDKTIFELIAEQASRTPAKAAVVCGEDTLTYQELMERSAQLANALREKGIASGSIVSIMAEHSLELIVAIMAVLRSGAAYLPIDPEYPQDRIQYLLDDSQTTLLLTQSHLQPNIRFAGSVLYLDDRSLYEGGSTSFAPESKPDDLAYMIYTSGSTGNPKGAMITHQGLVNYIWWANKVYVQGEAVDFPLYSSISFDLTVTSIFTPLLSGNTIHVYRGADKVQVILDIIKDNKVGIIKLTPTHLKLIEHIDGKASSIRRFIVGGENLPTKLAKQIYDHFGENVQIFNEYGPTETVVGCMIYLYDPQTTTQESVPIGVPADNVQLYLLDASMQPVPVGSLGEMYIAGDGVAKGYFNRPELTKEKFIDNPFRPGTKMYRTGDLAKWLPDGNMEYAGRMDYQVKIRGHRIEMGEIETRLTQHEAVKEAVVIVEKDESGQNVLYAYLVSERELTVAELREFLGRTLPSYMIPSFFIRLAEIPLTANGKVERKKLPKPAGAVVTGTAYAAPQNEIEAKLAEIWQQVLGISQVGIHDDFFDLGGHSLKAMTVVFQVSKALEVELPVKALFEHPTVAELARFLSRSEKTEYTAIQPVAA

SEQ ID NO: 11 - DNA, 3198 bp, Artificial Sequence
  synthetic
ttgttcgaacatccaaccgttgcggagctggcccgcttcctttcgcggtcggaaaaaaccgagtacaccgcgattcaacccgtggcagcgcaggagttttacccggtttcatctgcgcaaaaaagaatgtatatcctgcaacagttcgaaggcaacggaatcagctacaacatttcgggtgcgattctcctggaaggaaagctggactacgcccggtttgccagcgctgtgcaacagctggcagagcgccacgaagctttgcgcacctcgttccaccggatcgacggcgagcctgtgcaaaaagtgcacgaggaagtagaagtgccgcttttcatgctggaggctcccgaagaccaggcggagaaaatcatgcgcgagtttgtccgtccgtttgatctcggggtcgctccgctgatgcgaacaggtttgctcaagctgggcaaagaccgccatttgtttttgctcgacatgcaccatatcatctcggacggcgtttcttcgcaaattttgctgcgtgaatttgccgagttgtaccagggagcagacttgcagccgctttcgctgcaatacaaagatttcgctgcttggcaaaatgagctgtttcagacggaggcatacaagaagcaggagcagcactggctgaacacgtttgctgatgaaattccgctcttgaacctgccgactgactatccgcgccctagcgtgcaaagctttgcaggcgatctcgtcctttttgccgccggaaaagaactgctggagcggttgcaacaggtagcgtcagaaacaggcaccaccttgtacatgattttgcttgccgcctacaatgtgctgctgtccaagtataccggccaggaagacatcatcgtcgggacgcctgtcgctggacgttcccatgcggacgtggaaaacatcatgggcatattcgtgaacacattggcgctgcgcaaccagcctgccagcagcaaaacgtttgcgcaatttttgcaggaagtcaagcaaaacgcgcttgcagcctatgaccatcaagattatccatttgaagaactcgtggaaaaactggcgattcagcgggatattagccgaaatccgttgtttgacacgttgttttctttggaaaacgcgaaccagcagtcgcttgccatcgccgagctgacagcgtcgccctatgagctgttcaacaaaatttccaagtttgatcttgctttgaacgcaagcgaatcgccagcggacattcagttccagctcacattcgcaaccaagctgttcaagaaagaaacggtcgagcgaatggcccggcattacctggaaattttgcgctggatcagtgagcagccaacggcaagcctcgcggacatcgacatgatgacggaagcggaaaaacgcacactccttctgaacgtgaacgatacgtttgtcgagcggactgccgcgaccgctttgcatcaattagtggaggagcaagcagcacgcacgcctgatgaagtggccgtcgtgtacgaagaatatgccttgacctatcgcgagctgaacgccagggcgaaccagctggcccgtttgctgcgcagtcacggaaccggaccagatacgttgatcggcattatggtggaccgttcgccaggcatggtcgtcgggatgctggctgtgctcaaagcaggcggcgcgtacacgccaatcgacccaagctatccgccagaacgaatccagtacatgctcagcgacagccaggcgccgattttgctgacgcagcgtcatttgcaggagctggctgcttatcaaggggagatcatcgacgtagacgaggaagcgatttacaccggagccgacacgaacttggacaacgtcgctggcaaagacgacttggcctatgtgatctacacatcgggatcgacgggcaatccgaaaggcgtcatgatctcccatcaggcgatttgcaatcacatgttgtggatgagagagacgttcccgctgacgaccgaggatgctgtcctgcaaaaaacgccgttcagcttcgacgcttccgtatgggagttttatttgccgctcatcaccggaggacaactggtgttggcaaagccggacgggcatcgcgacatcgcctacatgactcgtctcattcgagatgagaaaatcacgaccttgcagatggttccgtccttgctggatctggtcatgaccgacccgggctggagcgcatgcacgagcttgcagcgagtgttctgcggcggggaagcattgacgcctgccctcgtctcgcgtttttacgagacacagcaagctcagttgatcaacttgtacggccctacagagacaaccatcgatgcgacttattggccttgcccgcgccagcaggaatacagcgcaattccgatcggcaaaccgatcgacaacgtccggctgtatgtcgtcaatgccagcaaccagcttcagccagtaggcgtagcgggagagctgtgcattgccggagacggtttggcccgcggctattggcagcgcgaggagctgacgaaagcaagttttgtcgacaacccgtttgagccgggcggcaccatgtaccgtaccggagacatggtccgctatttgccagatggccatatcgagtatttgggacgcatcgaccatcaagtcaaaatcagaggtcaccgcatcgagctgggggaaatcgaagccacgcttttgcagcatgaagcggtcaaagcggtcgtcgtcatggcccgccaggatggcaaagggcaaaacagcctgtacgcctatgtcgtagcggagcaggacatccagacagcggagctgagaacgtacctgtctgccaccttgccagcctacatggttccgtccgcttttgttttcttggagcagctgccgctttcagcgaacggcaaagtggatcgcaaggcattgcctcaaccggaggatgccgccgcctctgctgccgtgtatgtggcgccgcgcaacgaatgggaagccaagctcgcagcgatatgggaaagtgtgcttggagtcgagccgatcggggttcacgatcatttctttgaactgggcggacattctttgaaagcgatgcacgtcatttctttgctccagcgcagcttccaggtggacgtaccgttgaaagtcctgtttgaatcgccaacgatcgcgggcctggccccacttgttgcggctgcccgcaaaggcacgtacacagcgatcccccctgtcgaa

SEQ ID NO: 12 - protein, 1066 aa, Artificial Sequence
  synthetic
LFEHPTVAELARFLSRSEKTEYTAIQPVAAQEFYPVSSAQKRMYILQQFEGNGISYNISGAILLEGKLDYARFASAVQQLAERHEALRTSFHRIDGEPVQKVHEEVEVPLFMLEAPEDQAEKIMREFVRPFDLGVAPLMRTGLLKLGKDRHLFLLDMHHIISDGVSSQILLREFAELYQGADLQPLSLQYKDFAAWQNELFQTEAYKKQEQHWLNTFADEIPLLNLPTDYPRPSVQSFAGDLVLFAAGKELLERLQQVASETGTTLYMILLAAYNVLLSKYTGQEDIIVGTPVAGRSHADVENIMGIFVNTLALRNQPASSKTFAQFLQEVKQNALAAYDHQDYPFEELVEKLAIQRDISRNPLFDTLFSLENANQQSLAIAELTASPYELFNKISKFDLALNASESPADIQFQLTFATKLFKKETVERMARHYLEILRWISEQPTASLADIDMMTEAEKRTLLLNVNDTFVERTAATALHQLVEEQAARTPDEVAVVYEEYALTYRELNARANQLARLLRSHGTGPDTLIGIMVDRSPGMVVGMLAVLKAGGAYTPIDPSYPPERIQYMLSDSQAPILLTQRHLQELAAYQGEIIDVDEEAIYTGADTNLDNVAGKDDLAYVIYTSGSTGNPKGVMISHQAICNHMLWMRETFPLTTEDAVLQKTPFSFDASVWEFYLPLITGGQLVLAKPDGHRDIAYMTRLIRDEKITTLQMVPSLLDLVMTDPGWSACTSLQRVFCGGEALTPALVSRFYETQQAQLINLYGPTETTIDATYWPCPRQQEYSAIPIGKPIDNVRLYVVNASNQLQPVGVAGELCIAGDGLARGYWQREELTKASFVDNPFEPGGTMYRTGDMVRYLPDGHIEYLGRIDHQVKIRGHRIELGEIEATLLQHEAVKAVVVMARQDGKGQNSLYAYVVAEQDIQTAELRTYLSATLPAYMVPSAFVFLEQLPLSANGKVDRKALPQPEDAAASAAVYVAPRNEWEAKLAAIWESVLGVEPIGVHDHFFELGGHSLKAMHVISLLQRSFQVDVPLKVLFESPTIAGLAPLVAAARKGTYTAIPPVE

SEQ ID NO: 13 - DNA, 3207 bp, Artificial Sequence
  synthetic
gtcctgtttgaatcgccaacgatcgcgggcctggccccacttgttgcggctgcccgcaaaggcacgtacacagcgatcccccctgtcgaaaagcaggagtattacccggtttccgcggcacagaagcgaatgttcattctgcagcaaatggaaggagcaggtatcagctacaacatgccaggcttcatgtatctcgacggcaagctggatacagagcggctgcaacaggcgctgaaaagtttggtgcaacgccacgaatcgttgcgcacctcgttccactccgtgcaaggcgagacggttcagcgtgtgcatgacgatgtcgatctggccatctcgtttggcgaagcgaccgaagcagagacccggcaaatagccgagcagtttatccagccgttcgatctgggaacagccccgctgttgcgtgccggactcatcaagctggcgccggaacgccacctgttcatgctcgatttgcaccatattgtcgtcgatggcgtctccatcggcctgctcatcgaggaatttgcccagctctatcacggggaagagctgccagcgctgcgcattcagtacaaagattttgccaagtggcagcaggactggttccagaccgaggaatttgccgagcaggaagcctactggctcaacacctttacgggagaaatccccgtgcttaatctgccgacggattatccaagaccgtctgtgaaaagctttgcgggagatcgcttcgtctttggctccggcactgctttgccaaaacaattgcatcagctcgcccaagagacaggcacgacgctctacatggttctgttggccgcctacaacgtgctcctgtccaaatactccaggcaagaggacatcatcgtcggcgctcctacggctggcaggtcccatgccgaaacggagtccatcgtcggaatgtttgtcaacacactggccttgcgcaacgagccagccgggggcaaaactttccgcgactttttggccgaagtgaaaatcaatacgttgggagcgtttgagcatcaagattatccgctcgatgaactcgtcgacaagctggacatgcaacgggatttgagccgcaaccctttgtttgacacggttttcattttgcaaaacatggagcaaaagccgttcgaaatggagcagttgacgattactccttattcggcagaggtgaaacaggccaagtttgacctgtcgctggaggcgtacgaagaaaacgcggaaatcatctttagcctggattacagcaccaagctgttttcgcgcgagacgatcgaaaaaatagcgacccattttatccaaatcttgcgggcggtcattgcggaaccggaaatgccgttgtccgagatcaccatgctcacagaggcggaaaagcagcgcttgctggtcgacttcaacggtgcgcacaaagattttccgcaaaacaaaacgcttcaggcgctttttgaagaacaagcggaaaagtcgccgcaggcaacagccgtggaaatcagcgggcagcccctgtcctatcaggagctgaatgagcgagccaaccagcttgccgctacgctgcgggagcggggagtacagcctgaccaacctgtagggattatggcgaaccgctctgtggagatggtcgtcggcatcctcgccatcttgaaagcaggcggagcttacgtgccgatcgacccggaatatccggaggagcgtgtcgcctacatgctgacggattgccaagcccgcctggtgctgacgcaaaagcatctgggagcgaagcttggttccagcgtgaccgcggaatgcctgtatctcgacgacgagagcaactatggtgtgcaccgctcgaatttgcagccgatcaataccgcttccgatctggcttacatcatctacacatcgggtacgactggcaagccaaaaggggtcatggtcgagcaccggggcatcgtcaacaacgtgctgtggaagaaagcggagtaccaaatgaaggttggcgacagaagcttgctgtctctgtcctttgcctttgacgctttcgttctgtccttctttacgcctgtgctttccggggcaactgtcgtactggcggaggatgaagaagccaaggacccagtctctttgaaaaagctcatcgccgcttcgcgctgcaccttgatgacaggcgtgccgagcttgttccaggccattctggaatgcagcacgccagcggatatccgtccgctgcaaaccgtcacactcggcggagaaaaaattacggcgcagcttgttgaaaaatgcaagcagctgaatcccgatctggtcatcgtcaacgagtacggcccgacagaaagcagtgtcgtcgccacctggcagcgccttgcgggtccggatgctgccatcaccatcgggcggccgattgccaacaccagcctgtacatcgtgaaccaatatcaccagctacagccaatcggcgtggtcggggagatttgcatcggcggccgcggcttggcacgaggctattggaacaagccagcgctcacggaagagaagttcgtttcccatccgtttgcggcaggcgagcgcatgtacaagacgggcgatcttggcaagtggctcccggacggaacgattgaatacattgggcgcatcgacgaacaggtcaaagtccgaggctaccgaattgaaatcggcgagatcgagtcggctctgctggctgcggaaaagctgacagcggctgttgtggtcgtctatgaggatcagcttggccagtcggctctggcagcgtattttaccgccgacgaacagcttgatgtcacgaagctgtggtcgcatctgtcgaagcgactcccgtcgtacatgattcctgcgcattttgtgcagctcgatcagcttccgcttacgccaaacggcaaagtcgacaagaaagccttgccgaagccagaaggcaagcccgtaaccgaagcgcaatatgtcgcgccgacaaatgcggtggaaagcaagctggcagagatttgggaacgcgtgctcggggttagcggcatcggcattctcgacaactttttccagatcggcggacattccttgaaagcgatggctgtcgctgcacaggtgcatcgcgagtatcaggttgagcttccgctgaaagtgctgttcgcgcagcctacgatcaaggcgttggcccagtatgtcgccacgagcggaaaagagacgtatgtgccgatcgagcctgcaccgttg

SEQ ID NO: 14 - protein, 1069 aa, Artificial Sequence
  synthetic
VLFESPTIAGLAPLVAAARKGTYTAIPPVEKQEYYPVSAAQKRMFILQQMEGAGISYNMPGFMYLDGKLDTERLQQALKSLVQRHESLRTSFHSVQGETVQRVHDDVDLAISFGEATEAETRQIAEQFIQPFDLGTAPLLRAGLIKLAPERHLFMLDLHHIVVDGVSIGLLIEEFAQLYHGEELPALRIQYKDFAKWQQDWFQTEEFAEQEAYWLNTFTGEIPVLNLPTDYPRPSVKSFAGDRFVFGSGTALPKQLHQLAQETGTTLYMVLLAAYNVLLSKYSRQEDIIVGAPTAGRSHAETESIVGMFVNTLALRNEPAGGKTFRDFLAEVKINTLGAFEHQDYPLDELVDKLDMQRDLSRNPLFDTVFILQNMEQKPFEMEQLTITPYSAEVKQAKFDLSLEAYEENAEIIFSLDYSTKLFSRETIEKIATHFIQILRAVIAEPEMPLSEITMLTEAEKQRLLVDFNGAHKDFPQNKTLQALFEEQAEKSPQATAVEISGQPLSYQELNERANQLAATLRERGVQPDQPVGIMANRSVEMVVGILAILKAGGAYVPIDPEYPEERVAYMLTDCQARLVLTQKHLGAKLGSSVTAECLYLDDESNYGVHRSNLQPINTASDLAYIIYTSGTTGKPKGVMVEHRGIVNNVLWKKAEYQMKVGDRSLLSLSFAFDAFVLSFFTPVLSGATVVLAEDEEAKDPVSLKKLIAASRCTLMTGVPSLFQAILECSTPADIRPLQTVTLGGEKITAQLVEKCKQLNPDLVIVNEYGPTESSVVATWQRLAGPDAAITIGRPIANTSLYIVNQYHQLQPIGVVGEICIGGRGLARGYWNKPALTEEKFVSHPFAAGERMYKTGDLGKWLPDGTIEYIGRIDEQVKVRGYRIEIGEIESALLAAEKLTAAVVVVYEDQLGQSALAAYFTADEQLDVTKLWSHLSKRLPSYMIPAHFVQLDQLPLTPNGKVDKKALPKPEGKPVTEAQYVAPTNAVESKLAEIWERVLGVSGIGILDNFFQIGGHSLKAMAVAAQVHREYQVELPLKVLFAQPTIKALAQYVATSGKETYVPIEPAPL

SEQ ID NO: 15 - DNA, 3201 bp, Artificial Sequence
  synthetic
ctgttcgcgcagcctacgatcaaggcgttggcccagtatgtcgccacgagcggaaaagagacgtatgtgccgatcgagcctgcaccgttgcaagagtattatcctgtttcatctgcgcaaaagcggatgtatgtcctgcgccagtttgcggacacaggcacggtttataacatgccgagcgcgttgtatatcgaaggcgatctggatcggaagcgttttgaagccgccatccacggattggtcgagcggcacgaatcgctgcgcacatccttccacaccgtaaatggcgagcctgtccagcgcgtacacgagcatgtcgagctgaatgtgcagtacgcggaagtgacggaagcgcaagtggagccaaccgtcgagtcgttcgtgcaagcatttgatctgacaaaagctccgctattgcgggtcggacttttcaagctggcagcgaaacggcatctgttcctgctggatatgcatcacatcatctcggatggcgtctcggccggaatcattatggaagagttctcgaagctgtatcgaggcgaagaactgcctgcgctttccgtccattacaaagatttcgccgtctggcagtctgaactgttccagagcgacgtctataccgagcatgaaaactactggctgaacgcgttttctggcgacattccggtgcttaacttgccagccgatttttctcgtccgctgacacagagctttgaaggagattgcgtttcgttccaggcagacaaagcgttgctggacgatcttcacaagctcgctcaggagagccaatcgacgttgttcatggtattgctggcggcttacaatgtgctgcttgccaagtacagcggacaggaagacatcgtcgtcggcacaccgattgcgggcagatcgcacgccgatatcgagaacgttctggggatgtttgtcaacacgctcgctttgcgcaactatccggtcgagacgaaacacttccaggcatttttggaagaggtcaagcaaaatacgctgcaagcatacgcccatcaagattatccgttcgaagcactggtcgaaaagctggacatccagcgggatctcagccgcaatccgctgtttgacaccatgtttattttgcaaaacctggaccaaaaagcttacgagctggatgggctgaaactggaggcatatccggcacaagcaggcaacgccaaattcgatctcacgctggaagcgcacgaggacgagacaggcattcattttgcgctcgtctactcgaccaaattgttccagcgagaatcaatcgaaagaatggcgggtcacttcctgcaagtgctgcgccaagtcgttgccgaccaagcaactgccttgcgcgagatcagcctgctcagcgaggaagagcgccgaattgtgaccgttgatttcaacaacacgtttgccgcgtatccgcgcgatctgacgattcaggagctgttcgagcagcaggcagcaaaaactccggagcatgcagcggtcgtgatggacggacagatgctgacgtatcgggagctgaacgaaaaagcgaaccagctcgcccatgtccttcgtcaaaacggagtcgggaaagagagcatcgtcggtctgctcgcagatcgttcgctggaaatgattacaggcatcatggggattctcaaagcgggcggcgcctacctgggactggacccggagcatccgtccgaacgcctggcttacatgttggaagatggcggcgtgaaagttgtcctcgtgcaaaagcacttgctgccgctcgtcggcgaagggctgatgccaatcgttttggaagaggagagcctgcgcccggaagattgcggcaatccggcgattgtcaacggtgcgagtgacctggcttatgtgatgtacacctcaggctctacaggcaagccaaaaggagtcatggtcgagcatcgcaacgtcacccgcttggtcatgcatacgaattacgtgcaagtgcgcgagagcgaccggatgattcaaaccggcgcgattggcttcgacgccatgacatttgagatttttggagccttgctgcacggggccagcctgtatttggtgagcaaggacgtcttgctggatgccgaaaagctgggcgacttcctgcggacgaatcagattacgaccatgtggctgacctcgccgctcttcaaccagctttcgcaagacaatccggcgatgtttgacagcttgcgcgccttgatcgtcggtggcgaagcgttgtcgccgaagcacatcaaccgggtaaaaagtgcccttcctgacctggaaatctggaacggatacggcccgaccgaaaacacgaccttctcgacgtgctatttgattgagcagcattttgaagagcagattccgatcggcaagccgattgcaaactccaccgcgtatatcgtcgacggcaacaatcagccgcagccgatcggcgtaccgggtgaactgtgcgtcggtggtgacggtgtcgcaagaggctatgtgaacaagccggaattaaccgccgaaaagtttgtgcccaatccgtttgcgcctggcgaaacgatgtatcgcaccggagatttggcgagatggctgccggatgggacgattgagtatttgggccgaatcgaccagcaggtcaaaatcaggggataccggatcgagcttggggaaatcgagacggtcttgtcccagcaggcacaagtaaaagaagcagtcgtggccgtgatcgaggaggcgaacgggcaaaaagctctctgcgcttactttgtgccagaacaggccgtcgacgccgcagagctgcgagaagcgatgtccaaacaattgcctggctacatggtccctgcttactatgtgcaaatggaaaagctgccgttgaccgcgaacggaaaggtcgaccgccgggcattgccgcagccatccggcgagcggacgacaggaagcgcctttgtcgctgcgcaaaatgataccgaagcgaagctgcaacagatttggcaagaagttttgggcattccggcaatcggcattcacgacaacttctttgaaatcggcggtcattccttgaaggcgatgaacgtcatcacgcaagtccataaaacattccaggtggagctgccgttaaaagcgctgtttgccactccgacgatccatgagttggctgcgcatattgccgagagcgcattcgagcagttcgagacgatccagccagtcgagcctgccgcg

SEQ ID NO: 16 - protein, 1067 aa, Artificial Sequence
  synthetic
LFAQPTIKALAQYVATSGKETYVPIEPAPLQEYYPVSSAQKRMYVLRQFADTGTVYNMPSALYIEGDLDRKRFEAAIHGLVERHESLRTSFHTVNGEPVQRVHEHVELNVQYAEVTEAQVEPTVESFVQAFDLTKAPLLRVGLFKLAAKRHLFLLDMHHIISDGVSAGIIMEEFSKLYRGEELPALSVHYKDFAVWQSELFQSDVYTEHENYWLNAFSGDIPVLNLPADFSRPLTQSFEGDCVSFQADKALLDDLHKLAQESQSTLFMVLLAAYNVLLAKYSGQEDIVVGTPIAGRSHADIENVLGMFVNTLALRNYPVETKHFQAFLEEVKQNTLQAYAHQDYPFEALVEKLDIQRDLSRNPLFDTMFILQNLDQKAYELDGLKLEAYPAQAGNAKFDLTLEAHEDETGIHFALVYSTKLFQRESIERMAGHFLQVLRQVVADQATALREISLLSEEERRIVTVDFNNTFAAYPRDLTIQELFEQQAAKTPEHAAVVMDGQMLTYRELNEKANQLAHVLRQNGVGKESIVGLLADRSLEMITGIMGILKAGGAYLGLDPEHPSERLAYMLEDGGVKVVLVQKHLLPLVGEGLMPIVLEEESLRPEDCGNPAIVNGASDLAYVMYTSGSTGKPKGVMVEHRNVTRLVMHTNYVQVRESDRMIQTGAIGFDAMTFEIFGALLHGASLYLVSKDVLLDAEKLGDFLRTNQITTMWLTSPLFNQLSQDNPAMFDSLRALIVGGEALSPKHINRVKSALPDLEIWNGYGPTENTTFSTCYLIEQHFEEQIPIGKPIANSTAYIVDGNNQPQPIGVPGELCVGGDGVARGYVNKPELTAEKFVPNPFAPGETMYRTGDLARWLPDGTIEYLGRIDQQVKIRGYRIELGEIETVLSQQAQVKEAVVAVIEEANGQKALCAYFVPEQAVDAAELREAMSKQLPGYMVPAYYVQMEKLPLTANGKVDRRALPQPSGERTTGSAFVAAQNDTEAKLQQIWQEVLGIPAIGIHDNFFEIGGHSLKAMNVITQVHKTFQVELPLKALFATPTIHELAAHIAESAFEQFETIQPVEPAA

SEQ ID NO: 17 - DNA, 3213 bp, Artificial Sequence
  synthetic
gccactccgacgatccatgagttggctgcgcatattgccgagagcgcattcgagcagttcgagacgatccagccagtcgagcctgccgcgttttatcccgtgtcgtttgcccaaaagcgaatgtacatcctgcatcagttcgaaggaagcgggatcagctacaacgtgccgagtgtgctggtgctggaaggcaagctcgattatgaccgctttgctgctgccatccagagcctggttaaacggcatgaatctttgcgcacctcgttccattcggtaaacggggaaccgctgcaacgagtacatccggatgtcgagctgcctgtccgccttttggaggcgacagaagatcagagcgaatcgctcatccaggagctaatccagccgtttgatctggagatagccccgttgttcagagtgaatctgatcaagcttggcgcagagcggcacttgttcttcatggatatgcaccacattatttccgatggcgtatcgcttgcggtcatcgtcgaggaaattgccagcttgtatgcaggaaaacagctttccgacctgcgcatccagtacaaagactttgctgtgtggcagaccaagctggctcagtcggatcgcttccaaaaacaggaggatttttggacccggacgtttgccggggagattcctttgctgaatctgccccatgattatccaagaccttctgtgcagagctttgacggtgacacggtcgcgcttggcaccggacatcacctgctggaacaactgcgcaagctcgctgccgagactggcacgaccttgttcatggtgctgctggctgcctaccatgtgttgctctccaagtacgccggacaggaagaaatcgtcgtcggcacaccgatcgcaggccgctcgcacgcagatgtcgagcgcattgtcgggatgttcgtcaacacgctcgctttgaaaaatacggccgctggcagcctgagcttccgcgcctttttggaagacgtgaagcaaaatgcgctccatgccttcgagcatcaagactatccgttcgagcatctggtcgagaagctgcaagtgcggcgcgatctgagcagaaacccgctgtttgatacgatgttcagcctggggcttgccgaatcagccgaaggagaagtagcggatctgaaagtgtcgccttatccggtgaacggccacatcgccaaattcgacctttccctggatgcgatggaaaaacaggatggacttcttgttcaattcagctattgcacgaagctgttcgcaaaagaaacggttgatcgactggccgcccattacgttcagcttttgcaaacaatcacagccgatcccgacatcgagctcgcccggatcagcgtgttgtccaaagcagagacggagcacatgctgcacagcttcctcgcaaccaaaacagcctatccgacggacaaaacgttccagaagctgttcgaggagcaagtggaaaaaacaccgaacgagattgccgttctgttcggcaatgaacagctgacctatcaggagttgaatgcaaaagcaaaccagctcgcccgcgtcctgcggcgaaaaggcgtcaagccggagagcaccgtcggcatcctcgtagaccgctcgctctacatggtcatcggcatgctggccgtgttgaaagcaggcggaacattcgtcccgattgatccggactacccgctggagcgccaagcgttcatgctcgaagacagcgaggcgaagctgctgctcaccttgcaaaaaatgaacagtcaagttgccttcccttatgaaaccttttatctggatacagagacagtggatcaggaggagacgggcaatctggagcacgttgcgcagccggagaacgtcgcttacatcatctacacatccggtacgacgggcaagccaaaaggggtcgtcatcgagcaccgcagctatgccaatgtcgcatttgcctggaaagacgaatatcacctggacagcttcccggtccgtttgctgcaaatggcgagcttcgcctttgacgtctcgacgggcgattttgccagggcgctgctgacaggcgggcaactggtcatctgcccgaatggggtcaaaatggacccagcttcgctgtacgagaccatcaggcgtcacgaaattaccattttcgaagcgacacccgccttgatcatgccgttgatgcactacgtttacgaaaacgaactggatatgagccaaatgaagctgctgattctcggagcagacagctgcccggcggaagacttcaaaacgttgctcgcgcgcttcggtcagaagatgcgcattatcaacagctacggcgtgacagaggcgtgcattgacaccagctactacgaagaaacagacgtcaccgccatccgctcgggaacggtgccgatcggcaaaccgcttccgaacatgacgatgtacgtggtcgatgcgcatttgaatttgcagcctgtcggcgtcgtaggcgaattgtgcatcggcggagcaggggttgcgcgcggttatttgaacagacctgagctgacggaagagaagttcgtgccgaatccgttcgccccaggtgaacgattgtaccgcacaggtgatctggcgaagtggcgcgcagatggcaatgtcgagttcctcggacgcaatgaccaccaggtaaaaatcaggggtgtccgcatcgagctgggcgagatcgagacacaactgcgcaagctggacggaattacggaagcagtcgtggttgcgagagaagatcgcgggcaggaaaaggaattgtgcgcatacgtcgtggcggaccacaagcttgacaccgcagaattgcgggcgaatttgctgaaggaactgccgcaagcgatgattccagcgtatttcgtcaccttggatgcgctgccgctgactgccaatggcaaagtagacagacgttccttgccagcgccggatgtcaccatgctgagaacgaccgagtatgtagcgccgcgctccgtctgggaagcccgattggcccaagtatgggagcaggtgctgaatgttccgcaagtgggtgcgctagacgactttttcgcgctcggcggtcactcattgcgtgccatgcgcgtcctttccagcatgcacaacgaataccaggtcgacatcccgctgcgcatcttgttcgaaaaaccgacgattcaggaactggcggcgttcatcgaagagacagccaaagggaatgtcttctcgatcgagcctgtgcaa

SEQ ID NO: 18 - protein, 1071 aa, Artificial Sequence
  synthetic
ATPTIHELAAHIAESAFEQFETIQPVEPAAFYPVSFAQKRMYILHQFEGSGISYNVPSVLVLEGKLDYDRFAAAIQSLVKRHESLRTSFHSVNGEPLQRVHPDVELPVRLLEATEDQSESLIQELIQPFDLEIAPLFRVNLIKLGAERHLFFMDMHHIISDGVSLAVIVEEIASLYAGKQLSDLRIQYKDFAVWQTKLAQSDRFQKQEDFWTRTFAGEIPLLNLPHDYPRPSVQSFDGDTVALGTGHHLLEQLRKLAAETGTTLFMVLLAAYHVLLSKYAGQEEIVVGTPIAGRSHADVERIVGMFVNTLALKNTAAGSLSFRAFLEDVKQNALHAFEHQDYPFEHLVEKLQVRRDLSRNPLFDTMFSLGLAESAEGEVADLKVSPYPVNGHIAKFDLSLDAMEKQDGLLVQFSYCTKLFAKETVDRLAAHYVQLLQTITADPDIELARISVLSKAETEHMLHSFLATKTAYPTDKTFQKLFEEQVEKTPNEIAVLFGNEQLTYQELNAKANQLARVLRRKGVKPESTVGILVDRSLYMVIGMLAVLKAGGTFVPIDPDYPLERQAFMLEDSEAKLLLTLQKMNSQVAFPYETFYLDTETVDQEETGNLEHVAQPENVAYIIYTSGTTGKPKGVVIEHRSYANVAFAWKDEYHLDSFPVRLLQMASFAFDVSTGDFARALLTGGQLVICPNGVKMDPASLYETIRRHEITIFEATPALIMPLMHYVYENELDMSQMKLLILGADSCPAEDFKTLLARFGQKMRIINSYGVTEACIDTSYYEETDVTAIRSGTVPIGKPLPNMTMYVVDAHLNLQPVGVVGELCIGGAGVARGYLNRPELTEEKFVPNPFAPGERLYRTGDLAKWRADGNVEFLGRNDHQVKIRGVRIELGEIETQLRKLDGITEAVVVAREDRGQEKELCAYVVADHKLDTAELRANLLKELPQAMIPAYFVTLDALPLTANGKVDRRSLPAPDVTMLRTTEYVAPRSVWEARLAQVWEQVLNVPQVGALDDFFALGGHSLRAMRVLSSMHNEYQVDIPLRILFEKPTIQELAAFIEETAKGNVFSIEPVQ

SEQ ID NO: 19 - DNA, 3933 bp, Artificial Sequence
  synthetic
atcttgttcgaaaaaccgacgattcaggaactggcggcgttcatcgaagagacagccaaagggaatgtcttctcgatcgagcctgtgcaaaagcaagcgtactatccggtctcctcggcacaaaagcgcatgtacatcctcgatcaatttgagggagtcggcatcagctacaacatgccgtcgactatgctgatcgaaggcaagctggagcgaacacgggtagaagcggcgttccagcgcttgattgcgcgacatgaaagcctgcgcacttcgtttgccgtcgtcaacggagagcctgtgcaaaacattcacgaggacgttccgtttgcgcttgcctattcggaagtcacagaacaggaggcgcgcgaactcgtttcttctctcgtgcagccgttcgatctggaggtcgcaccactcatccgcgtgtcgctgctgaaaatcggcgaggatcgttacgtgctctttaccgacatgcatcacagcatttccgatggcgtatcctccggcattcttttggcagagtgggtgcagctgtaccagggtgacgttttgccggagctgcgtatccagtacaaggactttgctgtgtggcaacaagagttttcccagtcggctgccttccacaagcaggaagcgtactggttgcaaacgtttgccgatgacattcctgtgctgaacttgccgaccgatttcacccgccccagcacccaaagctttgccggggatcagtgcacgatcggcgcgggcaaagcgctcacggaaggcttgcaccagttggcgcaggcgacgggaacgactttgtacatggttttgctcgccgcgtacaacgtgctgctcgccaagtatgccgggcaggaggacatcatcgtcggcacgccgattacaggcagatcccatgccgatctcgaaccgatcgtcggcatgttcgtgaacaccttggcgatgcgaaacaaaccgcagcgcgaaaagacttttagcgagtttttgcaagaagtcaagcaaaatgcgctggatgcgtacggccatcaggattacccgtttgaagaactggtggaaaagctcgcgatcgcgcgcgatttgagccgaaatccgctgtttgacaccgtgtttacgttccaaaacagcacggaagaggtcatgacgctgcctgaatgcacgcttgcgccgtttatgacggacgaaacaggccagcacgccaagttcgacttgactttcagcgctacggaagagcgggaagaaatgacgattggcgtggagtacagcacaagcttgtttacgcgggaaacgatggaacggttcagccgccacttcctgacgattgcagcgagcatcgtgcaaaatccgcacatccgtctgggcgagatcgacatgcttttgccagaagaaaaacagcagattttggccgggttcaacgatacggcagtcagctatgcgctggacaaaacgctgcaccagctattcgaagagcaggtcgacaaaacaccggatcaggcagcgcttctctttagcgagcaatcgctgacgtacagcgaactgaacgagcgagcaaacagactggcaagggtcctgcgcgcaaaaggagtcggaccggaccgtctggtagcgatcatggcggagcgctcgccggaaatggtgatcggtattctcggtattttgaaggcaggcggcgcttatgttcccgtcgatcccggctatccgcaggagcgcattcagtacctgctcgaagatagcaacgcagccctgctgctcagccaggcgcatctgttgccgctgttggcccaggtgtcaagcgagctgccggagtgccttgatctgaacgctgaactggatgccggactgagcggctccaacctgccagctgtcaaccaaccgactgaccttgcctacgtcatctatacatccggtacgaccggcaagccgaagggtgtcatgatcccgcatcaaggaatcgtgaactgcttgcagtggagaagagacgaatacgggttcgggccgagtgacaaggcgttgcaagtgttctcctttgccttcgacggttttgtagccagcttgttcgctccgctgctcggaggggcaacgtgcgtgttgccgcaagaagcagctgccaaagacccggtcgcgctgaaaaaactgatggccgcaacggaagtcacccattactacggcgtaccgagtctgttccaggccattctcgattgctcgacgacaaccgacttcaatcagttgcgttgcgtcactttgggcggcgagaagctgcctgtgcagcttgtgcaaaaaacaaaagaaaagcatccggcaatcgagatcaacaacgagtacggcccgacggaaaacagcgtcgtcaccaccatctcgcgctcgattgaagcggggcaagcgatcacgattggccgaccgcttgcgaacgtccaagtctacattgtagatgagcagcatcacttgcagccgattggcgtggtcggtgagctgtgcatcggcggagccgggcttgccagaggctatctgaacaaaccggagctgaccgcagagaagtttgtcgcaaatccgttccgaccaggcgagcgcatgtacaaaacaggcgacttggtaaaatggcggacggatggcacgatcgagtacatcggccgcgcagacgaacaggtcaaggtgagagggtatcgcatcgagatcggcgagatcgagagcgccgtactcgcttaccagggcatcgatcaagcggtggtcgttgcgcgagacgatgacgctacggctggttcctatctttgcgcctactttgtcgcagcaacagccgtgtccgtatccggcttgagaagccatctggccaaagagctgcctgcttacatgattccgagctatttcgtcgagctggatcagctgccgctttccgccaatggaaaagtggatcgcaaagctttgccgaagccgcaacagtccgatgcgaccacgcgcgaatacgtggccccgaggaatgcgaccgaacagcaactggcagccatctggcaagaagttttgggagtagagccaatcggcatcaccgaccagttctttgaactcggaggacattccttaaaagctacgctgttgattgccaaagtgtatgagtacatgcaaatcgagctgccgctgaatctcatcttccagtatccgacgatcgaaaaggtggccgatttcatcacgcataagcgctttgagagcagatacggcacagccattttgttaaatcaggagacggcgcgaaacgtattttgcttcacgccgatcggcgcacaaagcgtgtactaccagaagcttgcggcggaaattcaaggcgtctctttgtacagctttgatttcatccaggatgacaaccggatggagcagtatatcgcggcgatcaccgcaattgatccaagcggtccgtacacgctcatgggctactcctcgggaggcaatctggcttttgaagtggcgaaagaactggaggagcggggctatggcgtcaccgacatcatcttgttcgactcgtactggaaagacaaggcgattgagcggactgtcgcggaaacagaaaacgacattgcccagctattcgccgagattggcgaaaacaccgagatgttcaacatgacgcaagaagacttccagctgtacgccgccaatgagtttgtcaagcaaagcttcgttcgcaaaacggtcagctatgtgatgttccataacaatctggtcaataccggaatgaccactgccgcgatccacctcatccaatccgagctggaagcagacgaggaagctccggtggcagccaagtggaacgaatcagcctgggcaaacgcaacgcaacgactgctgacgtacagcgggcacggaatccactcgcgcatgctggcgggcgattacgcgtcgcaaaatgcttcgattttgcaaaacatcctgcaagaactgttcatcctgaaa

SEQ ID NO: 20 - protein, 1311 aa, Artificial Sequence
  synthetic
ILFEKPTIQELAAFIEETAKGNVFSIEPVQKQAYYPVSSAQKRMYILDQFEGVGISYNMPSTMLIEGKLERTRVEAAFQRLIARHESLRTSFAVVNGEPVQNIHEDVPFALAYSEVTEQEARELVSSLVQPFDLEVAPLIRVSLLKIGEDRYVLFTDMHHSISDGVSSGILLAEWVQLYQGDVLPELRIQYKDFAVWQQEFSQSAAFHKQEAYWLQTFADDIPVLNLPTDFTRPSTQSFAGDQCTIGAGKALTEGLHQLAQATGTTLYMVLLAAYNVLLAKYAGQEDIIVGTPITGRSHADLEPIVGMFVNTLAMRNKPQREKTFSEFLQEVKQNALDAYGHQDYPFEELVEKLAIARDLSRNPLFDTVFTFQNSTEEVMTLPECTLAPFMTDETGQHAKFDLTFSATEEREEMTIGVEYSTSLFTRETMERFSRHFLTIAASIVQNPHIRLGEIDMLLPEEKQQILAGFNDTAVSYALDKTLHQLFEEQVDKTPDQAALLFSEQSLTYSELNERANRLARVLRAKGVGPDRLVAIMAERSPEMVIGILGILKAGGAYVPVDPGYPQERIQYLLEDSNAALLLSQAHLLPLLAQVSSELPECLDLNAELDAGLSGSNLPAVNQPTDLAYVIYTSGTTGKPKGVMIPHQGIVNCLQWRRDEYGFGPSDKALQVFSFAFDGFVASLFAPLLGGATCVLPQEAAAKDPVALKKLMAATEVTHYYGVPSLFQAILDCSTTTDFNQLRCVTLGGEKLPVQLVQKTKEKHPAIEINNEYGPTENSVVTTISRSIEAGQAITIGRPLANVQVYIVDEQHHLQPIGVVGELCIGGAGLARGYLNKPELTAEKFVANPFRPGERMYKTGDLVKWRTDGTIEYIGRADEQVKVRGYRIEIGEIESAVLAYQGIDQAVVVARDDDATAGSYLCAYFVAATAVSVSGLRSHLAKELPAYMIPSYFVELDQLPLSANGKVDRKALPKPQQSDATTREYVAPRNATEQQLAAIWQEVLGVEPIGITDQFFELGGHSLKATLLIAKVYEYMQIELPLNLIFQYPTIEKVADFITHKRFESRYGTAILLNQETARNVFCFTPIGAQSVYYQKLAAEIQGVSLYSFDFIQDDNRMEQYIAAITAIDPSGPYTLMGYSSGGNLAFEVAKELEERGYGVTDIILFDSYWKDKAIERTVAETENDIAQLFAEIGENTEMFNMTQEDFQLYAANEFVKQSFVRKTVSYVMFHNNLVNTGMTTAAIHLIQSELEADEEAPVAAKWNESAWANATQRLLTYSGHGIHSRMLAGDYASQNASILQNILQELFILK

SEQ ID NO: 21 - DNA, 3177 bp, Artificial Sequence
  synthetic
atgggaaacacattttacccgctgacacatgctcaaaggagaatttggtacacggaaaagttctatcccggcacaagtgtttcaaatttgagcggctttggaaaattaaaatctgcctccggaatcgattccgggttattgactgaagccattcgccagtttgttcgtacgaatgaaaccatgcgattcaggctgatgtttgaaggagaggatgagccgaagcaatatatagcggaagacgaacctttccagattgaatgttttgacgcttcagaaagcggaggagcagacggcgttcttaaatggggacaagctgaggcgcgccggcccctgcctttgtatggaagtccgctgtttaaatttgccgtcgttcgtatcagtgaagaagaaagctggttttttgcaaaagttcatcatatcatttccgacggtatttcgatgacgatcctgggcaaccgcattacagacatttatttgaagcttgccaaaggggaaaccggcctcgaacctgttcagtcatcatttacggaacatattcagagtgagttggagtatgaaaattcgaagcggttccagaaggataaagcatattggaacgcacaatatgaagtgatcccagagcccgtatcgttaaagtcgagcgatacgtatcagatccaattggatgcagcccgcttttcaaaagagatttcccccgccctgtataaaaaaattcaaacgtattgtaaggaacacaatataagcgtactttccctgttcttatcgattttgcacatttatatgcaccggataaccggacaaaaagatgtcgttctcggcacatttatgggtaaccggacaaatgcaaaagaaaaacagatgctcgggatgtttgtgttgacgattccgatgaaagcctccattgatgtacaccaggactttagtgcatttgtgcaggaaaggatgaaagatcagctgaagatcattcggcatcaaaagtatccgtacaatctgctgattaatgatttgcgggaaagacagccgcatgtcagcaaattgttctccgtctcactggaatatcaagttatgcaatggcagcggaaagaaacgttgtcatttcttacagagccgattttcagcggcagtgaagtaaacgatatttccattcacgtgaaagagagatgggacaccgggacgcttgcgattgattttgattacagggaggagcttttcacctgtgaagaattggccgttttatatgaacggctgatgacgctgcttgaagatgccctgctgtttccgcaaaaaacaatcgccgaactggagattgttcccgcttttgaaaaagagcggctgttaaagcgtgcatcaagccaaaccatcgcatatgacaagaacatgaccttgcacggtttattcgaacaaaaagcagccgatcatccagaaaaaaccgcggttgtatatgaaggacaaaaactttcgtaccgcgagctgaatgaacaatcgaatcgtctggcaagggcgcttcgaagaagaggcatcgggcctgacgctccggctgcagtagtgatggagcggtcagagcgggttattacggcgatgctgggcgttttgaaagccggcggagcttatgtaccgatcgatcccggatttccggaagaaagaattcgctttatgctggaggattcaaaggtcaaagtggttatcacagacagcgggctgacttttgaaacggccgaaactgtgcggttcagcgaagcgctttctgaatcgctggaaaacggtcacccgtcttcagaggcaggcgccgggcaccttgcatatatcatttatacttccgggacaacgggccgtccaaaaggcgtcatgattgaacacaggcaggtccaccaccttgtaagagggcttcagcaggccgttggtgcatatgatcaggatgatttgaagctggcacttctggctccgtttcattttgacgcttccgttcagcagatttttacgtctctattgcttggccaaacgttgtacatcgtaccgaaaaagacggtttccgacggacgcgctttatcggattattaccgccgccatcaaatcgatgtgacagacggtacgccggctcatttgcagcttttgtctgctgccgatgatctttcaggtgtcaaactgaggcatatgcttgttggaggagaggcattatcaagggtcgcaacggaaaggctgcttcaattatttgcagaaacagctgaatccgtgcctgatgtaacgaatgtttacggcccgactgaaacttgtgtggatgcttcttcttttacgatgacaaaccacgcagatcttcaaggcgatacggcctatgtcccgatcggcagaccgattggaaacaaccgtttttatattttggatgaaaacggtgcactccttcctgatggtgtcgaaggggaattgtatattgcaggagacggagtcggccgaggctatttgaacttacctgacatgaccgcagacaagttcttggaagacccgtttgtccccggaggtttcatgtatcgaacaggggatgcagtacgttggcttcctgacggtacggttgatttcatcggccgaaaagacgatcaagtgaaaatccgcggctaccggatcgagcttggcgagatagagtcggtgctgcaaggagcccctgctgtcggaaaagcagttgtcctcgcgcggcccgaaaccggcggcagccttgaggtttgcgcttatgtcgtgccaaaacaaagcggggaaattcaccttcaggggctgagggagcatttatccaagcatctgcctgactatatgataccttcccactttgtcgagcttgatgaaataccgctgacgggaagcggcaaagtcgaccggaaagcgctgcttcgccatgaagtctctgtcagcgggactgcagagtatgcggcaccgagaaatgaatatgaagaaaaaatggtgggtatatggcaggaagtgctcggaactgaacaagtcggaatccacgaccagttttttgaactgggcggccattctctcaaagcgatggccatgctggcaaaaatttataaagctttcggtgtcgaggttccgttgcaagtcctgttcgaaaaaccgacagtggcggcgttaagcggctttgtttctgaagcggagaaagacggattcacggttattgaacctgcgccggaa

SEQ ID NO: 22 - protein, 1059 aa, Artificial Sequence
  synthetic
MGNTFYPLTHAQRRIWYTEKFYPGTSVSNLSGFGKLKSASGIDSGLLTEAIRQFVRTNETMRFRLMFEGEDEPKQYIAEDEPFQIECFDASESGGADGVLKWGQAEARRPLPLYGSPLFKFAVVRISEEESWFFAKVHHIISDGISMTILGNRITDIYLKLAKGETGLEPVQSSFTEHIQSELEYENSKRFQKDKAYWNAQYEVIPEPVSLKSSDTYQIQLDAARFSKEISPALYKKIQTYCKEHNISVLSLFLSILHIYMHRITGQKDVVLGTFMGNRTNAKEKQMLGMFVLTIPMKASIDVHQDFSAFVQERMKDQLKIIRHQKYPYNLLINDLRERQPHVSKLFSVSLEYQVMQWQRKETLSFLTEPIFSGSEVNDISIHVKERWDTGTLAIDFDYREELFTCEELAVLYERLMTLLEDALLFPQKTIAELEIVPAFEKERLLKRASSQTIAYDKNMTLHGLFEQKAADHPEKTAVVYEGQKLSYRELNEQSNRLARALRRRGIGPDAPAAVVMERSERVITAMLGVLKAGGAYVPIDPGFPEERIRFMLEDSKVKVVITDSGLTFETAETVRFSEALSESLENGHPSSEAGAGHLAYIIYTSGTTGRPKGVMIEHRQVHHLVRGLQQAVGAYDQDDLKLALLAPFHFDASVQQIFTSLLLGQTLYIVPKKTVSDGRALSDYYRRHQIDVTDGTPAHLQLLSAADDLSGVKLRHMLVGGEALSRVATERLLQLFAETAESVPDVTNVYGPTETCVDASSFTMTNHADLQGDTAYVPIGRPIGNNRFYILDENGALLPDGVEGELYIAGDGVGRGYLNLPDMTADKFLEDPFVPGGFMYRTGDAVRWLPDGTVDFIGRKDDQVKIRGYRIELGEIESVLQGAPAVGKAVVLARPETGGSLEVCAYVVPKQSGEIHLQGLREHLSKHLPDYMIPSHFVELDEIPLTGSGKVDRKALLRHEVSVSGTAEYAAPRNEYEEKMVGIWQEVLGTEQVGIHDQFFELGGHSLKAMAMLAKIYKAFGVEVPLQVLFEKPTVAALSGFVSEAEKDGFTVIEPAPE

SEQ ID NO: 23 - DNA, 3207 bp, Artificial Sequence
  synthetic
ctgttcgaaaaaccgacagtggcggcgttaagcggctttgtttctgaagcggagaaagacggattcacggttattgaacctgcgccggaaagtgacgattatcctctctcattggcgcagcagcgaatttatatcgtcagccagctggaggatgccggagtcggctacaatatgccggccgcggcgatgcttgagggcacccttgatgttcagcgccttgaagctgcttttcaaaaactgattgataggcatgaggcgctgcgcacttcgtttacagttgtcgatggcgaaccgagacagaacattcatcaaagggttcagttcaagattgagaaggttaaagcagatgggaagccgatcgaacaaatggcgaaatcttttgtccgccgctttgatctcgccaaagctccgctgatgagagcaggtctcgtccgtctcgcagaccgcagacatgtgctgttgttcgatatgcatcatcttgtgtctgacggcgtatcgatttcgatcatattgaatgagctggccgcactgtataaaggggaagaactgccggagccgaatttgcattacaaagattatgctttctggcaaaggacgcatgctccaaaaggttttcaaaaagaagaggcttattggcaaagcgtgttcgcccgcgagcttcccgtactgcagctgataacggatgagccgaggccgtctgttcaaagctttgaaggagaccgggtatccgcagtcctgccacaagacatgaaagaaaaattagccgtgctggcagagcaaaacggcgcgacattgtatatggtcatgctggccgcatacaacatgctgctagcaaagtactccgggcaagaagatgtgatcgtcggaacgccggcggccggccgcagacattccgatctggaaggaatcatcggcatgtttgtcaatacgctggcgatccgttcaaaagtggagtcgggcagaacgttcagagacttcctgcatgatgtaaagaaaacggtaatcgacgcttttgagcatcaggaatatccgtttgagcggcttgcggaaaaggttggtgcatcgcgcgatttaagccgtcatcccgtctttgacacgatgtttattttgcaaaatgcatgggaagacattccgatgctcggcgatttgcacctctcgatttatgaaacgaacttcaatattgcaaagttcgacctaacgctgcaggcgaaagaagagcagggagaattgattctcgatttggattacagtacgaagctgtttaaaaaagatacggcagaaaggatgctgaaagcatatttgcaccttctggagggcatgacggctgatccgctgcgcagaatcggcgagtacagccttttgacagaagaggaaacgaatcgtcagctcgtcgcgttcaaccccgcggcaagcgattatccgagggagaaaacgatcgttcagctatttgaggaacaggcggcggaaagaggcggacatcccgccctgcaatttgaagacaaagtatggtcatacggtgagctcaatcggaaagcgaaccaattggcgaggcgcctccgcgaaagaggtgtacagcccggcacgacggcagccattctcaccgccaggtcggctgaaatggtcatcggcattctcgctgtgctgaaagccggcgctgcttatgtgccgatcgatccggatcatcctgaaaaacgtgtgcaacatttcttcgaggacagcggagcggcggttcttttaacgcaaaaggcgatgaagccgctcgctgaggcggctgaatttggcggcgacattctatttcttgaggatgaacacctttatctgggagatgcgtctgatttgcgccttccgatttcaccggaagcaatggccaatctaacgtatacatccggaacgactgggacgcctaagggcaatatggtttctcaccggaatatattgcgtacggtaaaaaacacaaattacttggatgtgatgacatccgatatcgttctttcaatttcaaattacgtgtttgatgcctttatgtttgatgtgttcggttcattgctgaacggcgccaagctggtgatagctccaaaagacacgattcttgatatgagccggctcgcacatgtacttgaaaaagaaaaggttaccgtcttaatgatcacgaccgcattattcaatctgctgacagacatgcggccggacagtttgaagggactccgcagggttctgttcggcggcgaacgtgcatctgtcgatcatgtcagaagagctctgaacacagttggcaaaggacggctgcttcatatgtacggcccgtctgagagcactgtctttacaacctattatccagtcaacgaagtgccggacgatgcgcaggctataccgatcggaaagcctgtcagcaatacggaggttctgattcttgattcattcggcaatgtacagccggcaggggttgcgggagaattgtgcgtcggcggagacggccttgtccgcggctattttaaccgcccggaactgacggctgaaaagtttacggaacatccgttcaaaaccggtgagaagatttaccggacgggcgatatggcgagatggcttgccgacggatgtctcgaatttatcggacggattgatcatcaggtcaaaattcgcggacagaggatcgagctgggcgaaatcgagcaccatctcgtcacacatgaaatggttcaggaagccgctgttcttgctgttgacaccgggaagagagatcaaatgatctgtgcttactttacggccgatcaggagctttctagtgaagagcttcgccgatatgcggcagaaggtctgccgggctacatgatcccgtccgtgtttatgcagctgcaggagcttccgctcacaggcaatggaaaggtcgacagaagggcgctgcctgagccggatgtcacgcaggccgcgcaaaaggaatatacggcgccaaggagccgaacaggagcacagcttgccgatctttggcaggaggtgctcaatgtaccgaaaatcggtgtgcatgacaatttctttgaacttggcggacactctttaatcggaatgacgctcattgcccgtatccagcaagagatgaatgttgatctgcagctgaaagatttgttccaggcgccgacaatcgaaaccctggcgcaggctgcggaaaaaactgagaaaaaatcagccgtttatattgaagcggtgccggac

SEQ ID NO: 24 - protein, 1069 aa, Artificial Sequence
  synthetic
LFEKPTVAALSGFVSEAEKDGFTVIEPAPESDDYPLSLAQQRIYIVSQLEDAGVGYNMPAAAMLEGTLDVQRLEAAFQKLIDRHEALRTSFTVVDGEPRQNIHQRVQFKIEKVKADGKPIEQMAKSFVRRFDLAKAPLMRAGLVRLADRRHVLLFDMHHLVSDGVSISIILNELAALYKGEELPEPNLHYKDYAFWQRTHAPKGFQKEEAYWQSVFARELPVLQLITDEPRPSVQSFEGDRVSAVLPQDMKEKLAVLAEQNGATLYMVMLAAYNMLLAKYSGQEDVIVGTPAAGRRHSDLEGIIGMFVNTLAIRSKVESGRTFRDFLHDVKKTVIDAFEHQEYPFERLAEKVGASRDLSRHPVFDTMFILQNAWEDIPMLGDLHLSIYETNFNIAKFDLTLQAKEEQGELILDLDYSTKLFKKDTAERMLKAYLHLLEGMTADPLRRIGEYSLLTEEETNRQLVAFNPAASDYPREKTIVQLFEEQAAERGGHPALQFEDKVWSYGELNRKANQLARRLRERGVQPGTTAAILTARSAEMVIGILAVLKAGAAYVPIDPDHPEKRVQHFFEDSGAAVLLTQKAMKPLAEAAEFGGDILFLEDEHLYLGDASDLRLPISPEAMANLTYTSGTTGTPKGNMVSHRNILRTVKNTNYLDVMTSDIVLSISNYVFDAFMFDVFGSLLNGAKLVIAPKDTILDMSRLAHVLEKEKVTVLMITTALFNLLTDMRPDSLKGLRRVLFGGERASVDHVRRALNTVGKGRLLHMYGPSESTVFTTYYPVNEVPDDAQAIPIGKPVSNTEVLILDSFGNVQPAGVAGELCVGGDGLVRGYFNRPELTAEKFTEHPFKTGEKIYRTGDMARWLADGCLEFIGRIDHQVKIRGQRIELGEIEHHLVTHEMVQEAAVLAVDTGKRDQMICAYFTADQELSSEELRRYAAEGLPGYMIPSVFMQLQELPLTGNGKVDRRALPEPDVTQAAQKEYTAPRSRTGAQLADLWQEVLNVPKIGVHDNFFELGGHSLIGMTLIARIQQEMNVDLQLKDLFQAPTIETLAQAAEKTEKKSAVYIEAVPD

SEQ ID NO: 25 - DNA, 4542 bp, Artificial Sequence
  synthetic
ttgttccaggcgccgacaatcgaaaccctggcgcaggctgcggaaaaaactgagaaaaaatcagccgtttatattgaagcggtgccggaccgggatacgtacccggtatcttcggcgcaaaaacggctgtacgtcctacagcagattgaaggcgcagagaaaagctatcacatgccggccgttctccagcttgaagggaagcttgatttgaagcgcctcgagtctgccgcgcaaatgctgatcaagcgccatgaagcattccgcacgacatttgaaatcaaggacggcgaacctgttcagcggatttgggaagctgcggaattgaccattgatgtcatcgatgcagatgaacaagaagcggaaaagctgattaaagaattcatcaggccgtttgatttaacaaaagccccgttatttagaatgagcatcatacgtttcacgggagaaaaacatcttttgcttgtggatatgcatcatatcatttcagacggcgcttctgtcagcgtcctgatcgatgaaatgacaaagctttatgctggagaggcgcttgaaccgctgaggattcagtataaagacttttctgtatggcagcagcatctgctgacagaacggcacaaagtgcaggaggaatactggctcaaggagctggccggcgagctgcctgttttgacgcttccggcagactatccgcgtccttctattcaaacgtttgaaggaagccgtctcagctttgcgctgaaaccggagcttgtccagcagctgagaaaactggccaaggaaacggacagcactttatacatggtgctcgctgcctcatacagcgcgcttttatccaaactgagcggacagagcgaggtcattgtcggctctccggctgccgggcggccgcatactgatttgaaccggatcatcggcatgtttgtcaatacgcttgcaataagaacgcgtcctgaaggagacaagccgttttctgcattccttgaggaagtgaaagaaacgacgctcggcgcgtttgagcatcaagattacccgtttgaagaactcatcgagaagctgaacatccagcgcgacatgagccgaaacccattgtttgatgccgtcttttcaatgcgaaatgccgatttgaaagacttgtcaatggaagggatcacactcaagccgtatgattttgcccatcagactgcgaagtttgacctgacgctgacagcggcggaagaggacggacttctcgtttttgaaatggaatacaatacagctctctttaagcatgaatcgatcgagcgctggcgcgggtactgggtcaatctgctcgaagcggttgccgaaaatccggatgcccgcctttcagagctttcgcttctggatgaagcggaaaaacggcggatcgtccaaaattggaatgagacgagactggctgtgccgcaggacaaaacggtccatgagctgttcgaagcgcaagttctccgcacgcctgaccgtggggcagcggtgtacaacggcgtgaagtggacgtataaagagctgaacgcacgggcgaaccgtctggcccggctgctgatcgaaaaaggggcccgtcctgaacagcggatcgggatcatggtcaagccttcgcttgaaatggccgctggcgtgctcgcgattttgaaagcgggagcggcctatgtgccgatcgatcctagctatccggctgaacggatcggatacgtgctgaaagacagtggcgcagagctgcttctgacgcaaacaaacttagccgcacctgaagaattcagcggtgaaacacttcttctcgattcgatgctgagcgaagaaatcacaaaagacgatgaggtgaacccacaggcaggtacacagtctgacaacctggcctacttgatctacacatcgggcacgaccggccagccgaaaggcgtcatggtcgaacaccggtcgcttgtgaatttgtgttattggcataatgacgcctttaaggtcaccgaacaggacaaaagcgcgaaatatgccggcttcggctttgatgcttccgtctgggaaatgttcccgtactggatcgccggagcggagcttcacatcatcgatgaagcgatccggatggatattacgcgcttgaatcaatactttgaagagaacaaaataacgatcacgttcctgccgacacagttgtgcgaacagttcatggagctggacaaccagtcgctgcgcgtgctgcttacgggcggagacaagctgaaacggatcgcaaaacgctcctacacgctcgtcaacaactatggaccgacggaaaacacggtcgtcgcgacgagcacggcgattgatcctgataaaggaatgctttcaatcggaaagccgatcgccaatacgcgggcgtatgtgctaggacaaaacaacgaagtccagcccgtcggtgtcgcgggtgagctgtgcatcgccgcccgcgggcttgcgcgcggctatctgaacaagccagaggaaacggcgaagcgttttacggaagacccgtttgtgccgggcgagcgcatgtaccggacgggggacgcggtcaaatggctggaagacggacggcttgagtacatcggccgaatcgaccagcaggtgaaaatccgcggcttccggatcgaactttctgaaatcgaagtccagctcgcgcggctctctgaagtgcaggaagccgtcgtcaccgacatcgaagacgcctgcggcaacaaagcgctgtgcggctatgtcgttgcgaatgaacagcttgatacagaaagcctcgcccggaagctggcgcagacgctcccggactacatggtaccgtcattctgggtgcagcttaaagagcttccggttacggcgaacggaaaagtcgaccgaagggcgctgcctcagcctgacgtcgaagcgcagacagccgaatacaaagcgccgcttacagaaacggaacagctgttggcggacatttggcaggaggttctcggtatagaccgaatcgggatcacagacaatttcttcgcgctcggcggagactcgatcaaaggaattcaaatggcaagccggcttcagcagcacgggtggaagctggagatgaaggacttgtttcagcacccgacgatcggagagctgagtgcttatgttcaagcggctgacgatcagccgatcgatcagaaccctgtcgaaggcgaagtcacattgacgccgattcagcgctggttctttgagcgccgatttacgaacgagcatcactggaatcagtcggtcatgcttcacgctttaacgggattcgacccggaaacggcaggcaaggctttaagcaagctgatcgaacatcatgacgcacttcgcatggtttatcaacgaaatggagacgggattgttcagtacaacagagggctggaagaaacagcggttcgccctgaagtcatccgcttcaatgaatcgggcgctgaacttgaagctgccgtgttgaaggcatcaaaccggattcaaagcagtatcgatttaaccgaaggcccgcttttgaaagcggcgatctttaaaacggatcaaggcgatcatcttctcattgttattcatcatctcgttgtggacggaatctcatggagaatcctccttgaggatttcgccgccgggtacgcccaggctgaaaaaggggagccgattattcttcaagacaagacgcactcttttgctgaatatgcggctcgcctggaagaatatgcagggtcaaaagctttcgcaaaagaaatcggctattggcaggaaatcgaacaggcggagacggcagcgctcccgaaagacgatgaagcagaggacaagcggatgcgccatacgaaaacggctgagttttccctctcaaaagaagaaacggaacagttgatgacaaaagttcatgaagcatataacacggaaatgaacgacattttgcttacggcgttgggcttggcgctgaaagagtggacggggcaggaagactttatcatctgcttagagggacacggccgggaggacatcatagacggcttgaatatttcccggacggtcggctggtttacaagccagttcccggcgctgattcaaatgcgccattcaggggatatcggctatcaaatcaaacagatcaaagaagaattgcgccacattccgaataaaggaatcggctatggcatttatcgttatttgactgaagaaggcaaaaaggcgcagccgatcaagcatgatatcagcttcaactatttgggccagtttacagagatggcggattcgggtctgttcacgagatcaactttgccatccggcgatccgctcagcccggaaacggaaaaaccgaatgcgctggacatcgtcggctatatcgaagacggtattttgacaatgtcaatcgcttatcattcactcgaatataaagaaagcaccgtcgccgctgtcgccgcaagctttaaaacttatttgctgcaattgatcgatcattgcttagagcgggatgggggcgaactgaccccgagcgatcttggagatgacgaactcacgcttgaagaattagataaattgatggagattttc

SEQ ID NO: 26 - protein, 1514 aa, Artificial Sequence
  synthetic
LFQAPTIETLAQAAEKTEKKSAVYIEAVPDRDTYPVSSAQKRLYVLQQIEGAEKSYHMPAVLQLEGKLDLKRLESAAQMLIKRHEAFRTTFEIKDGEPVQRIWEAAELTIDVIDADEQEAEKLIKEFIRPFDLTKAPLFRMSIIRFTGEKHLLLVDMHHIISDGASVSVLIDEMTKLYAGEALEPLRIQYKDFSVWQQHLLTERHKVQEEYWLKELAGELPVLTLPADYPRPSIQTFEGSRLSFALKPELVQQLRKLAKETDSTLYMVLAASYSALLSKLSGQSEVIVGSPAAGRPHTDLNRIIGMFVNTLAIRTRPEGDKPFSAFLEEVKETTLGAFEHQDYPFEELIEKLNIQRDMSRNPLFDAVFSMRNADLKDLSMEGITLKPYDFAHQTAKFDLTLTAAEEDGLLVFEMEYNTALFKHESIERWRGYWVNLLEAVAENPDARLSELSLLDEAEKRRIVQNWNETRLAVPQDKTVHELFEAQVLRTPDRGAAVYNGVKWTYKELNARANRLARLLIEKGARPEQRIGIMVKPSLEMAAGVLAILKAGAAYVPIDPSYPAERIGYVLKDSGAELLLTQTNLAAPEEFSGETLLLDSMLSEEITKDDEVNPQAGTQSDNLAYLIYTSGTTGQPKGVMVEHRSLVNLCYWHNDAFKVTEQDKSAKYAGFGFDASVWEMFPYWIAGAELHIIDEAIRMDITRLNQYFEENKITITFLPTQLCEQFMELDNQSLRVLLTGGDKLKRIAKRSYTLVNNYGPTENTVVATSTAIDPDKGMLSIGKPIANTRAYVLGQNNEVQPVGVAGELCIAARGLARGYLNKPEETAKRFTEDPFVPGERMYRTGDAVKWLEDGRLEYIGRIDQQVKIRGFRIELSEIEVQLARLSEVQEAVVTDIEDACGNKALCGYVVANEQLDTESLARKLAQTLPDYMVPSFWVQLKELPVTANGKVDRRALPQPDVEAQTAEYKAPLTETEQLLADIWQEVLGIDRIGITDNFFALGGDSIKGIQMASRLQQHGWKLEMKDLFQHPTIGELSAYVQAADDQPIDQNPVEGEVTLTPIQRWFFERRFTNEHHWNQSVMLHALTGFDPETAGKALSKLIEHHDALRMVYQRNGDGIVQYNRGLEETAVRPEVIRFNESGAELEAAVLKASNRIQSSIDLTEGPLLKAAIFKTDQGDHLLIVIHHLVVDGISWRILLEDFAAGYAQAEKGEPIILQDKTHSFAEYAARLEEYAGSKAFAKEIGYWQEIEQAETAALPKDDEAEDKRMRHTKTAEFSLSKEETEQLMTKVHEAYNTEMNDILLTALGLALKEWTGQEDFIICLEGHGREDIIDGLNISRTVGWFTSQFPALIQMRHSGDIGYQIKQIKEELRHIPNKGIGYGIYRYLTEEGKKAQPIKHDISFNYLGQFTEMADSGLFTRSTLPSGDPLSPETEKPNALDIVGYIEDGILTMSIAYHSLEYKESTVAAVAASFKTYLLQLIDHCLERDGGELTPSDLGDDELTLEELDKLMEIF

SEQ ID NO: 27 - DNA, 3153 bp, Artificial Sequence
  synthetic
atggggaaacaaaagattcaaaaggtgtatcctttgacaccgatgcaggaagggatgctgtaccacgcaatgcttgatccggaatcttcctcttacttcacacagctggagctattcatagacggggaatttgatttggggatctttgaaaaaagcgtgaatcagctcgtgcgttcatacgatattctcagaacggtttttgttcaccagcaattgcaaaaaccgcgccaggttgtcctggctgaacggcaggcaatagtggaatttgaggatcttgccgacttggatgaggaaaagcaaaacaaccggattgaccggtataaacaagaagtacaggctgccgggtttaatttggcgaaagacatgctgtttaaaacggcggtctttcggcttgaccggaataagtaccttctcgtctggagcaaccatcatatcgtgatggacggctggagcatggggatattaatgaaacgcctttttcaaaactatgaagcgtttcgagcaaaccggacggttccgcttgatcagggaaaaccgtatgcggactatattaaatggctcggccggcaggataagggtgaagcggcatcctactgggaacaccgcctttcgggtttagaaagtccgagcgtcattcccggcggcaaaccgcggccggattcagaatcgtaccggaacgaggagtttacgtttgtttgggacaagaatatggtggatgcccttcaacaggcggcaaaccgctatcatgtcacagctcccaacctttttcaggcgatttggggagcggttcttgccaaatataacagaaccgatgatgtggtgttcggcacggttgtgtccgggcgcccgtcggaaattgacggaatcgagcatatggcagggctattcatcaacacgatccctgtccgtttaaaggtcgatcaaaacgcatcgtttgccgagctgttcaaacaagcacagcagcatgcgatttacgcggagcggtacgactacctaccgctctatgagattcaaaagcggtcggcattggacggccgcttgatcagccatcttgtcgcgtttgagaactatccgcttgataaggagcttgaaaacggaacgattcatgagaggctcggcttttccatcaaggctgccggagcttttgaacaaacgaattacgactttaatttgatcgtttatccgggagctgagtggacgatcaaattgaaatacaacggtgcggcttttgatgcggctttcattgagcaggccgccgggcatttaacgagacttgcagaagaggcgattgcaaatcccgagtcaaaagcagccagcgccgccatgttatcaaaacaggagcaacaaacgctgctcgcttttaatcaaacaaaatccgattatccaagagaaaagacgatcccggagctgtttgaagaacaggttaaagcgtctcctgacaaaacggctgttgccgctgacggaagaagcctgacttaccgcaggctgaatgagaaagccaatcagctcgcgagaagactgaaagttaaaggcttgatgcaacgggaaatgccgcccgccattatgatggagcggtcgcttgaagcagccgtcagcatgctggcggtgctgaaagcaggcggcgtgtacgtgccgatcgatcccggatatcctgaagagcggattcgctttttgctcgaagacagcgggtcaaagatcgtccttacaaaagacagtacgcagatttcgctggaagggtatgaggtgctcgccgtaaatgcgatggatgcagaaaaagaagatgccgccaaccttgaacatgtcaacaagcccgaagatcttgcctattacatttatacatccggatcgacgggcaggccgaagggcgttatggtcgaacaccgcaatatcgtccgccttgtcaaaaatgcgggctgcatcccgctgaagagcggcgtgaagatggcgcagacaggggctgtcagctttgatgccagtacatttgaagtattcggcgcactgctaaacggaggaaccctttatcccgtcccgaaagagacgctccttgatggaaaaaggttcaacatgtttctgaaggaaaccggaatcacaacaatgtggctgacttcgcctcttttcaatcagcttgctcagcaggatccgggaatgtttgcaaccttgaacgatctgattatcggcggagatgcccttgttccgggaatcgtcaacagagtcaaacgcgaatcaccggaactgtcgctttggaacggatacgggcccaccgaaaatacgacattttcgacctgttttttgatcgatcaagcatatgagagaacgatcccgattggaaagccgatcggaaattcaaccgcctatatcgttgatgaatacggctcgcttcagcccatcggtgtgcccggtgagctgtgtgtcggcggagacggggtggcgcgcggctacttgaaccagcctgagctgacagatgaaaagtttgtcggcgatccttttgccgaagggaagcggatgtaccgcacgggcgacttggcaaaatggcttcccgacgggaatatcgaattcctcggccggatcgatcatcaagtgaaggttcgcggcttccggatcgaattaggcgaggttgaagcggctttagcccgccttgagggaatttcagaagcggccgctgtcattcgggaaaacaacgccggagaaaacgagatttgcgcctattacgctggcgcgaggccggccgcgcagctgcggacagagctgtcccggtcgcttccggagtatatgattccggcccatttgatcgaactcgacagcatgccgctgacagccaacggaaaggttgacaaacgtcagcttccggctcctatcgctgaagagactgctagattcgaagcgccaaaaaatgaaacggaggaaattctggcggcaatctgggaagagattctcggcatcaagcagccgggaatcgatgacaacttcttttccatcggcggacactcgctgaaggcgatgatgctgactgccaaaatacaagagcagctccaaaaagaggtgccgatcaaagtattgtttgaaaaaccgacgatcagagagctggccgaatttcttcaaggagaaacaaaagagaaaaccgcttcgattacgccggctccgttccgtccgaat

SEQ ID NO: 28 - protein, 1051 aa, Artificial Sequence
  synthetic
MGKQKIQKVYPLTPMQEGMLYHAMLDPESSSYFTQLELFIDGEFDLGIFEKSVNQLVRSYDILRTVFVHQQLQKPRQVVLAERQAIVEFEDLADLDEEKQNNRIDRYKQEVQAAGFNLAKDMLFKTAVFRLDRNKYLLVWSNHHIVMDGWSMGILMKRLFQNYEAFRANRTVPLDQGKPYADYIKWLGRQDKGEAASYWEHRLSGLESPSVIPGGKPRPDSESYRNEEFTFVWDKNMVDALQQAANRYHVTAPNLFQAIWGAVLAKYNRTDDVVFGTVVSGRPSEIDGIEHMAGLFINTIPVRLKVDQNASFAELFKQAQQHAIYAERYDYLPLYEIQKRSALDGRLISHLVAFENYPLDKELENGTIHERLGFSIKAAGAFEQTNYDFNLIVYPGAEWTIKLKYNGAAFDAAFIEQAAGHLTRLAEEAIANPESKAASAAMLSKQEQQTLLAFNQTKSDYPREKTIPELFEEQVKASPDKTAVAADGRSLTYRRLNEKANQLARRLKVKGLMQREMPPAIMMERSLEAAVSMLAVLKAGGVYVPIDPGYPEERIRFLLEDSGSKIVLTKDSTQISLEGYEVLAVNAMDAEKEDAANLEHVNKPEDLAYYIYTSGSTGRPKGVMVEHRNIVRLVKNAGCIPLKSGVKMAQTGAVSFDASTFEVFGALLNGGTLYPVPKETLLDGKRFNMFLKETGITTMWLTSPLFNQLAQQDPGMFATLNDLIIGGDALVPGIVNRVKRESPELSLWNGYGPTENTTFSTCFLIDQAYERTIPIGKPIGNSTAYIVDEYGSLQPIGVPGELCVGGDGVARGYLNQPELTDEKFVGDPFAEGKRMYRTGDLAKWLPDGNIEFLGRIDHQVKVRGFRIELGEVEAALARLEGISEAAAVIRENNAGENEICAYYAGARPAAQLRTELSRSLPEYMIPAHLIELDSMPLTANGKVDKRQLPAPIAEETARFEAPKNETEEILAAIWEEILGIKQPGIDDNFFSIGGHSLKAMMLTAKIQEQLQKEVPIKVLFEKPTIRELAEFLQGETKEKTASITPAPFRPN

SEQ ID NO: 29 - DNA, 3216 bp, Artificial Sequence
  synthetic
aaaccgacgatcagagagctggccgaatttcttcaaggagaaacaaaagagaaaaccgcttcgattacgccggctccgttccgtccgaattacccggtttcgtccgcccaacggcgcatgtacatcctcaatcagctcgaagaagcaagcacgagttacaatgtgccggcggttctgcttttggaaggcgaattagataaggagcgtttggaagccgcgtttcgggccttgatcggccgccatgaaacattgcggacatcgttcgaattaatcgatggagaaatcgttcaaatcatccatcaagacgcggtttttcacctgacggaatcagtggcggaagaagcggaagccgaagcggcgatcagagaatttatccggccgtttgagctgaataaggcgccgctcgtcagggcggagctcgtgaagcttgaagaaaaacgccatctgctgatgatcgatatgcaccatattattacggacggaagctccaccggcatactgattcgcgacctggccggcttctaccacggagaagaagcgcctgcccctaagctccactataaagatttcgctgtgtggcaaaacggaccggagcatcaggagaaattgaaagaacaagaacagtattggattgacgtttttaaaggcgagctgcctgttctcgatctgccgtacgattttccacggccgtcaaaacgcagctttgaaggtgaccgtgtcgtcttcggaatcgatcaaaaactgacggcagacattcaaaagctgctttctgaagctgatgcgacactttatatgttcctgttggctgcatttaatatcctgctttccaagtatgcgtcacaggatgatttgatcgtcggatcgcccgtggcaggcagaacccatccggatttgcacaacattccgggcatgtttgtcaatacgctggcgctccgcaatcgtcctgaaggagaaaaaacgtttaagcagtttttgcaggaagtcaaagagacaagtcttcaaggctttgccaagcaggattatccgcttgaagaactgattgaaaaactgccattgccgcgggatacaagccgaaatccgctgttcagcgtctttttcaacatgcagaacatggaggtcccgacgctgaaactcggagatttgcagatttcgtcttactcggtgcgtcaccgcacggcgaagttcgatctgtcgcttgaggctgtggagcatgatggcgaaatcggtttgagttttgactatgccgtatccttatttaaagaagaaacgattaggcgctggagcggtcacttcttaaatgtgattaaaaaaatctgcgaaaaccccggcattaagctcagggacatcgaactgctttcagtcaaagagcgcgcacttctgctcgaagaagcgaggcgcagccaggcggagcgccttgaggagcggccgtttcatgtacagtttgaagaaaaggcggacgaaatgcctgatcagccggccgttgtctgcggggaaacgatcctcacataccgcgtgctcgacgaaaaagcaaatcagatcgcaaatgtgctgcgcagtgaaggcgtcggaaaagacgatgttgtcggcattatgctgaatcgttctgcagaggtcgccgcagcgattctaggtgtaatgaaatcaggaggcgcttttttgccgattgatccggaaatgccgacgagcagggtgcaatatatgctggaagacagcggagtccggtggctcttaacagaaccttcccatcaagcggatctcgcggattggtataccgggagactgatagatgtcagaaaagacacgctgatggcaagtaataaacggccgcatccaactacggacggagcgagtttggcgtacatcatctacacatccggaacgactggccggccgaaaggtgttcagctcgaacaccggaatctggcaaactatgtttcctggtttatcaatgaggcgcacctgtcatcttcggataaaacgatgcttttgtcttcctatgcgttcgatctcggatacacgagctttttcccggtgctgcttgccggaggagagctgcatatcgtcccgaaagaaacgtatacagaaccggaggcatttactcattatatcggtgaacaagggatcacatatatgaagctgacgccgtcgcttttccatacggtcgttcagccgcaaagcttcgctttggcaaaggggcttcagtcattgagactgattgtactagggggagaaaaaatcaatccgaaagatgtggagcggttccattcccgctatccggacaccagattcatcaatcattacggtccgacggaaacgacgatcggagcaatcgctaaaccgctcgagccggacatgatcggacaattcgccgagcgtccgacgattggaaggccgatttcgggcgccggagcactggtattagacgcctcccaccggcttgttcccgccggagcagcaggcgagctgtatataacgggaagcgggcttgcaagaggatatgtgaacaacccggaactcacggctgcgaagtttgtcgcaaatccttacacgccgggcacattcatgtaccgaacaggggatctcgtccgccgtcttccgaatggagagattgaatttttggggcggacggatgatcaggtgaaaatccgcggctacagaatcgaattgaaagaaatcgaagaagcctttaacgggcttgatgatatagagcgggctatcgttctttcctttacgactgactcggggttagacgaattgtgcgcttatattcaagcgaaacgacagctgccggtttccgaactgagagagcgtctttccgagcggctgccgtcgtacatgatcccgtcatacttcgtaacggtggataaaatgccgctttcggcaaacggaaaagtggaccgccgcgcgctcccggagccgcaaggtctaaacggacgaagcgattcgtatagagcgccgtcaaccgaaattgaaaaagccctctgcggcatttgggaagaggtgcttggcgttcagaaggtcggacttgacgacaatttcttcgatcttggcggacattcattaaaaggaatgatgctgatagcggaaatccaatccaggctcggaaaaaaagtaccgctaaaaacgttgttcgattttccgaccgccggcttgctcgcccgcagtattgaagcatccgaaggacagtcacaacaaagcgcgattcagcctgccgaa

SEQ ID NO: 30 - protein, 1072 aa, Artificial Sequence
  synthetic
KPTIRELAEFLQGETKEKTASITPAPFRPNYPVSSAQRRMYILNQLEEASTSYNVPAVLLLEGELDKERLEAAFRALIGRHETLRTSFELIDGEIVQIIHQDAVFHLTESVAEEAEAEAAIREFIRPFELNKAPLVRAELVKLEEKRHLLMIDMHHIITDGSSTGILIRDLAGFYHGEEAPAPKLHYKDFAVWQNGPEHQEKLKEQEQYWIDVFKGELPVLDLPYDFPRPSKRSFEGDRVVFGIDQKLTADIQKLLSEADATLYMFLLAAFNILLSKYASQDDLIVGSPVAGRTHPDLHNIPGMFVNTLALRNRPEGEKTFKQFLQEVKETSLQGFAKQDYPLEELIEKLPLPRDTSRNPLFSVFFNMQNMEVPTLKLGDLQISSYSVRHRTAKFDLSLEAVEHDGEIGLSFDYAVSLFKEETIRRWSGHFLNVIKKICENPGIKLRDIELLSVKERALLLEEARRSQAERLEERPFHVQFEEKADEMPDQPAVVCGETILTYRVLDEKANQIANVLRSEGVGKDDVVGIMLNRSAEVAAAILGVMKSGGAFLPIDPEMPTSRVQYMLEDSGVRWLLTEPSHQADLADWYTGRLIDVRKDTLMASNKRPHPTTDGASLAYIIYTSGTTGRPKGVQLEHRNLANYVSWFINEAHLSSSDKTMLLSSYAFDLGYTSFFPVLLAGGELHIVPKETYTEPEAFTHYIGEQGITYMKLTPSLFHTVVQPQSFALAKGLQSLRLIVLGGEKINPKDVERFHSRYPDTRFINHYGPTETTIGAIAKPLEPDMIGQFAERPTIGRPISGAGALVLDASHRLVPAGAAGELYITGSGLARGYVNNPELTAAKFVANPYTPGTFMYRTGDLVRRLPNGEIEFLGRTDDQVKIRGYRIELKEIEEAFNGLDDIERAIVLSFTTDSGLDELCAYIQAKRQLPVSELRERLSERLPSYMIPSYFVTVDKMPLSANGKVDRRALPEPQGLNGRSDSYRAPSTEIEKALCGIWEEVLGVQKVGLDDNFFDLGGHSLKGMMLIAEIQSRLGKKVPLKTLFDFPTAGLLARSIEASEGQSQQSAIQPAE

SEQ ID NO: 31 - DNA, 4575 bp, Artificial Sequence
  synthetic
ttgttcgattttccgaccgccggcttgctcgcccgcagtattgaagcatccgaaggacagtcacaacaaagcgcgattcagcctgccgaaaaacgcgactggtatccggtttcatccgctcagcaacggatgtatgccctccaccattttgaaaagaacggaacgggctacaacatgccgtctgttctcatgatggaaggcgtgcttgatacggatcgtttaagacgggcgttcgccgacttggtgaaccgccatgaatcattgcgaaccgcatttattgaaatcgatggccgtaccgttcaaattgtgcatgaaaaagcggacattgacttaaaggttattcatattcgtgaagaggacgcagaagcggaaatcaaccgctttatcagaccgtttgatctcagcaccgctccgctgatcagagccgagttgctttccatcagctctacgcgccatctgcttttgattgatacacatcatattattgcggacggcgtttccagaagccttttcgtcaaagaaatcgctcagctttataaaggcgcttcgctccctgagccgaagctgcactacaaggattatgcggtgtggcagcaagaacctgaccagcaagaaaacattcggaaacaggaagatttctggctccgtcagtttaaggaaagcgttccggaactcagccttccgctcgactttccgcgtcctcctgtccaaagctttgccggtgaccgggttcgctttaaagcatcaaaagacgccgcccttaaaatccgccgtttgacggcggaaacgaacacgacgctgaatattgtgatgctcgccgtttttaacctgtttttaagccgccttgccggccaaaaggatattgtcgtcggtacagcggcagcgggcagaacgaatgctgatctgaaagacatgccggggatgttcgtcaattcgttggcgctgaaaaaccatgtacctgatcaagcatcattcagcgagtttttggaagaggtcaaaaacaacagcctcgcagccctcgaccatcaggactatccgtttgaagagctgatcgccaagcttgatttgccgcgcgatatgagccggaatccgctgttcaatgtcatgctgacaacggaagatcctgataaagagacgctcgatttagacggtctgacaatcaagccgtatgagatttcacatgctgctgccaagttcgacctgacactgggggcttttgaaaaagatcatgaaatcggccttcagttcgaatatgcaacagatttgtttcagaaacaaacgattgaacgctggagcggatatttgcttaacctgctcgaagcggttgccgaaaacccggatgcccgcctttcagagctttcgcttctggatgaagcggaaaaacggcggatcgttcaaaattggaatgagacgaagcttgatgtgccggaggacaaaacggtccatgagctgttcgaagcgcaagtcctccgcacgcctgaccgcggggcagcggtgtacaacggcgtggagtggacatacaaagagctgaacgcgcgggcgaaccgcctggctcggctgctgatcgaaaaaggggcccgccctgaacagcggatcgggatcatggtcaagccttcgcttgaaatggccgctggcgtgctcggaattttgaaagcgggagcggcctatgtgccgatcgatcctagctatccggccgagcggatcggatacgtgctgaaagacagcggagcagagctgcttttgacgcaaagcggattaacggtgccagacacatttaccggagacgtgatcgatttgaatagagaaggctccattctggacggcgagctttatccagaggatgacatgaatccagactcgcaacgtcagtctgacaacctggcctacttgatctacacatcgggcacgaccggccagccgaaaggcgtcatggtcgaacaccggtcgctcgtaaacttgtgttattggcataatgacgcctttaaggtcaccgaacacgacaaaagcgcgaaatatgccggcttcggctttgacgcttccgtttgggagatgttcccgtattggatcgccggagcggagcttcacatcattgatgaagcgatccgaatggatattacgcgcttaaatcaatactttgaagagaacaaaataacgatcacgttcctgccgacacagttgtgcgaacagttcatggagctggataaccagtcgctgcgcgtgctgcttacgggcggagacaagctgaaacggatcgcaaaacgctcctacacgctcgtcaacaactatggaccgacggaaaacacggtcgtcgcgacgagcgcggcgattgatcctgatgaaggaatgctttcaatcggaaagccgatcgccaatacgcgggtgtatgtgctaggacaaaacaacgaagtccagcccgtcggtgtcgcgggtgagctgtgcatcgccggccgcgggcttgcgcgcggctatctgaacaagccagaggaaacggcgaagcgttttacggaagacccgtttgtgccgggcgagcgcatgtaccggacgggggacgcggtcaaatggctggaagatggacggcttgagtacatcggccgaatcgaccagcaggtgaaaatccgcggcttccggatcgaactttctgaaatcgaagtccagctcgcgcggctctctgaagtgcaggaagccgtcgtcaccgacatcgaagacgcctgcggcaacaaagcgctgtgcggctatgtcgttgcgaatgaacagcttgatacagaaagcctcgcccggaagctggcgcagacgctcccggactatatggtaccgtcattctgggtgcagcttgatgagctcccggttacggcgaatggaaaagtcgaccgaagggcgctgcctcagcctgacgtcgaagcgcagacagccgaatacaaagcgccgcttacagaaacggaacagctgttggcggacatttggcaggaggttctcggtatagaccgaatcgggatcacagacaatttcttcgcgctcggcggagactcgatcaaaggaattcaaatggcaagccggcttcagcagtacggatggaagctggagatgaaggacttgtttcagcacccgacgatcggagagatcagttcgtatattgaatgggccgatgctaaaccgatcaatcaaggacctgtcgaaggggaagtcacattgacgccgattcagcgctggttctttgaacgcaaatttacgaacgagcatcactggaatcagtcggttatgcttcacgcgccttcagggtttgacccggagctcgttgaacagacattggcggcattgacagagcatcatgatgcattgcgcatggtgtatcaaaagaaaaacgcccccttcattcagtataaccgcgggccgggcgaccgttcgttcccctttggagtggttgaccttcgatatgtcactgacattgaaacggaaatcgccgcccagtcaaaccgtcttcaggcaagccttgatctcgaaaacgggccgcttgtaaaggcagaacagtatcagactgcggaaggcgaccatttgctgatcgtcattcaccatttggtgatcgacggcgtgtcatggcgaattctgctggaagactttgcatcaggctactcgcaagccgcacagcagcatgacattgtcttccccgacaaaaccaattcgtttaaagattgggcaaaagagcttgaggcatatgcacaaaccgaacgctttcttaaaacggccgattattggcgcagacaggaacaagagcgcatttgcgagctgccgaaagatcgggctgccgcagaaagaaaagcggaaaacacttctgcagttacgtttgaattaagcgaagcggagacgcgtctgctgctgacgaaagtgcatgagccgtatggaacggatatcaacgacatcctgctttccgccctcagcctgacaatcagagaatggacgaacggctccaatatttgcatcaatatggaagggcacggcagggaggaaattattccggggatgaatatttcgagaacggcgggatggtttaccgcgcaatatccggttatttcaaaaagcgaagcagcggcaggattgcctgagaccattaaaaacgtcaaagaaacccttcggcgcattcctgacaaaggaatcggctacggcattcttcgctacttaacagaccggaaaaaagccggtgccgatttctcgatcaagcctgacatcagctttaactacctggggcagatcgacagggaggtgcagaccgatttcttcggaccttcttcttatgatatgggcagacttgtttctgaaaggtctgaagcgctctatgcgctgagcttcagcggcatcatcagcaaggaaaaattcatcttgtcatgttcattcaatacagaggaatatgacagacagaccgtacaagggctgatggacagattcaaagcttccctaacggcattgatcgaccattgtacagctaaagaggagcgcgaatttacaccgagtgatttttctgccggcgatcttgagatggaagaaatgggcgacctgtttgacgttcttgaagaaaacttgaaa

SEQ ID NO: 32 - protein, 1525 aa, Artificial Sequence
  synthetic
LFDFPTAGLLARSIEASEGQSQQSAIQPAEKRDWYPVSSAQQRMYALHHFEKNGTGYNMPSVLMMEGVLDTDRLRRAFADLVNRHESLRTAFIEIDGRTVQIVHEKADIDLKVIHIREEDAEAEINRFIRPFDLSTAPLIRAELLSISSTRHLLLIDTHHIIADGVSRSLFVKEIAQLYKGASLPEPKLHYKDYAVWQQEPDQQENIRKQEDFWLRQFKESVPELSLPLDFPRPPVQSFAGDRVRFKASKDAALKIRRLTAETNTTLNIVMLAVFNLFLSRLAGQKDIVVGTAAAGRTNADLKDMPGMFVNSLALKNHVPDQASFSEFLEEVKNNSLAALDHQDYPFEELIAKLDLPRDMSRNPLFNVMLTTEDPDKETLDLDGLTIKPYEISHAAAKFDLTLGAFEKDHEIGLQFEYATDLFQKQTIERWSGYLLNLLEAVAENPDARLSELSLLDEAEKRRIVQNWNETKLDVPEDKTVHELFEAQVLRTPDRGAAVYNGVEWTYKELNARANRLARLLIEKGARPEQRIGIMVKPSLEMAAGVLGILKAGAAYVPIDPSYPAERIGYVLKDSGAELLLTQSGLTVPDTFTGDVIDLNREGSILDGELYPEDDMNPDSQRQSDNLAYLIYTSGTTGQPKGVMVEHRSLVNLCYWHNDAFKVTEHDKSAKYAGFGFDASVWEMFPYWIAGAELHIIDEAIRMDITRLNQYFEENKITITFLPTQLCEQFMELDNQSLRVLLTGGDKLKRIAKRSYTLVNNYGPTENTVVATSAAIDPDEGMLSIGKPIANTRVYVLGQNNEVQPVGVAGELCIAGRGLARGYLNKPEETAKRFTEDPFVPGERMYRTGDAVKWLEDGRLEYIGRIDQQVKIRGFRIELSEIEVQLARLSEVQEAVVTDIEDACGNKALCGYVVANEQLDTESLARKLAQTLPDYMVPSFWVQLDELPVTANGKVDRRALPQPDVEAQTAEYKAPLTETEQLLADIWQEVLGIDRIGITDNFFALGGDSIKGIQMASRLQQYGWKLEMKDLFQHPTIGEISSYIEWADAKPINQGPVEGEVTLTPIQRWFFERKFTNEHHWNQSVMLHAPSGFDPELVEQTLAALTEHHDALRMVYQKKNAPFIQYNRGPGDRSFPFGVVDLRYVTDIETEIAAQSNRLQASLDLENGPLVKAEQYQTAEGDHLLIVIHHLVIDGVSWRILLEDFASGYSQAAQQHDIVFPDKTNSFKDWAKELEAYAQTERFLKTADYWRRQEQERICELPKDRAAAERKAENTSAVTFELSEAETRLLLTKVHEPYGTDINDILLSALSLTIREWTNGSNICINMEGHGREEIIPGMNISRTAGWFTAQYPVISKSEAAAGLPETIKNVKETLRRIPDKGIGYGILRYLTDRKKAGADFSIKPDISFNYLGQIDREVQTDFFGPSSYDMGRLVSERSEALYALSFSGIISKEKFILSCSFNTEEYDRQTVQGLMDRFKASLTALIDHCTAKEEREFTPSDFSAGDLEMEEMGDLFDVLEENLK

SEQ ID NO: 33 - DNA, 3864 bp, Artificial Sequence
  synthetic
atgaaaggggatacgattttgagccagttcaaaaaagaacatgtccaggacatatactatttgtcgccgatgcaggaagggatgctttttcatacgctgctgcatccgggacaaagcttttatattgaacaaatcagcatgcaggtgaaaggctcttttcaaaaagatatattggaaaaaagcatgaatgtcatcatcggcaggtatgatatattccgaaccgttttcgttcatgaaaaaatgaaacgtccggttcaagtcgttttaaaggaaaggtcgtttcaggcagaagaaattgatctatcaggactttctgaagcagaacaaaatgagagaatcgaagattataaacgaaaagataaagaaaaagggtttaacctctcaaaagacattccgatgagaaccgcggtttttaaaaagggacaggaccgttacgaatgggtgtggagctatcatcatattcttctggacggatggtgcttcgggatcgtcgtacaggaactgtttgaagtgtacaacgcgctccgcgaaaacaggctatacagcctcgggcccgtcaaaccttacaaagactatattaaatggctcgaaagtcaggacaaacaaagatcgctggcttactgggaacatcatttagccggattcgaagggcagacgacattcagcgaacagcggaaaaaaccggagcaagccggcaatcagccggaagaactgctgtttacacttccaaaagaagatacagaagtgttcacacagcttgcaaaagcgcatcataccacgttgagcacggctcttcaggcggtgtggtcggtgctgctcagccgctatcagcgatcccgcgatctgatcttcggtacagttgtgtcaggccgccccgctgacattcaaggtgtcgagcacatggtcggtttgtttatcaatgtcgtcccgaaacgggtaacctttggcgcgcacacgacctttacagagctggtcgctgaattgcagaagcaggcgcttgaagctgagccgcatcaatatatgccgctctatgatatccaaagtcatatagcagcgccgaacttgatcgaccacattatcgtttttgaaaattatccgctgcaagaagccaacaaacagcacgaagaaaaaaatctcggcttcacaatggatgatatcaccgtttttgaaaaatcgaattatgatctgaatttgctcgcctcaccgggggaagaaatgctgctgaaactcgcatacaacaggaatgtcttcgaaccatctttcatcttgcagctaaaagaacagctattgacagctattcgcgagatcatcacaaatccggagcagccgcttgacgacatttgtgtcgtatccaaaaaggaaaaagagcgccttctccatgaatttaacggccaagtccaacggaagcaaaccgggctgacgatcccgcaacggtttgagcaatgtgctgaagcgctcccggaacaacccgcggtatcagcggccgggcggacgctgacatatcgggaattgaacgaacaggcgaacaaggtcgcgcatcttttgcgcaaaaagaacgtcggccgcggcgaacctgtcgctcttttgttccgccgttcgccggaaatggtcatcgcgatactcgccgtcttaaaagcagggggcgcctatctgccgattgacccggaatatcctgaagcgcgaattcagtatatgctggaggacagcggggctgtttgcatgttgacacaagaagagcttgccggacaggcggcgtcgctttcttttcatcagaatacgatcttgatcgacgatccggcggtgtctgcagaaagcgggcgaaaccttgaaattgccgccgaaccggacgaccttgcttatatcatgtatacgtcaggcacaacgggaaaaccgaaaggcaatctgacgacccatgccaatattacaagagttgtaaaagagacaaactacatcagcctttccgagaaagacaccttgctgtccctttcaaactatgcgtttgacggcttcacatttgatgtgtacggcgcgcttttaaacggagcaaagctggtagtggccgatcaggcgacgattctccatatcggcaagctgacagaaacgattcagaaggaaaacatcacggtcatgtttgtgacaacggcgctgttcaacctcctggtcgatgcgggaacagagtggatgaaagggattcgcaaagttctgttcggcggagagcgctcatctgtcagccatgtcaagaaagcatttgccgccatgggaccggacaggatcattcatgtatacgggccgacggaaacgaccgtcttcgcgacgttctatccggtcaaccgcattgaggacaacgcggtttccattccgatcggcaagccgataaacgaaaccaatgcatacattctaacggaaaataaccggcttcaaccgattggagcggtaggtgaattgtgtctgagcggtacaggggtatcgcgtggctatttaaacaggccggaactgactgcggaaaaattcgtgccgcatccgttcaacagcggtgaaacgatgtacaggacaggggatctggcccgctggctgccggacggcaatatcgacttcatcggccggatcgatgatcaagtgaaaatccgcggccaccgaattgagctcggtgaaatcgaagaggagctgatgcgctgtcaaggcgtaaaggaagccgttgtaatcgccaagaaaagagggaatggggatgcggcgctcaccgcctatgtcgtcccggtgcggggagctgtggtttcgaacgaggaggttcgccgccaactggctcggaatctcccggcttacatggtgccggatgcatatatcatgcttgaagagctgccgctcaccgcaaacggaaaagtcaaccgccgccttcttcctgaagcagatggccggccgaatccaacagagcaccgtgcacctcgcaatatgacggaagaaaagcttgcgatcatttggtctgaggttctcggcagacagcagattggaatagacgagaacttttttgaaatcgggggacattcattgaaagctatggctgtcacctcccggatgctgaaagacctcgccatcgatgttccggtgaatgtgttgtttgaaatgcccacaatcgagggcctcgcggcttatatcgaccagggcggacatgcggatgacgtgaaaaaaaccgtcttcaatcaggaaagcacccgccatttgttcgcattcccacctgtcctcggctatggcatcgtgtacggcaaactggccgaacaaatgccggaatataagattcatgcgtttgactttatagaaagcgatgaccgcgccgtgcgctacgcagaagccatctccggccttcagccagaagggccgctgacattgatcggctattcggccggctgcggactcgcctttgaagtggcgcaaacactcgaaaagaacgggcggaaagtcgaaaagctgctgatgatcgattcatatatgaagaacggtgtcagcgatttagaagggcggtcaattgaagctgatacagctgctctgatggaagccaacaaggacaatgaatatatgaaaatcaagacggttgccgatggcatcgccaaaaaaatggcagcctattattcttactttgttaaccttgtccatcaaggaacggtcagctgcgagattcacttgatcaaatcagagcacgcgaaaccgctcccggaatggctttcgacgtggaaagaaggaacggagtcttcttatgatgaatatcaaggtgctggaagacatgatgaaatgctcgcggacgtctttgtcaaaaccaatgcagatctgatcagacagattttgggcgaacgtgccgctgtaatcgggggtgca

SEQ ID NO: 34 - protein, 1288 aa, Artificial Sequence
  synthetic
MKGDTILSQFKKEHVQDIYYLSPMQEGMLFHTLLHPGQSFYIEQISMQVKGSFQKDILEKSMNVIIGRYDIFRTVFVHEKMKRPVQVVLKERSFQAEEIDLSGLSEAEQNERIEDYKRKDKEKGFNLSKDIPMRTAVFKKGQDRYEWVWSYHHILLDGWCFGIVVQELFEVYNALRENRLYSLGPVKPYKDYIKWLESQDKQRSLAYWEHHLAGFEGQTTFSEQRKKPEQAGNQPEELLFTLPKEDTEVFTQLAKAHHTTLSTALQAVWSVLLSRYQRSRDLIFGTVVSGRPADIQGVEHMVGLFINVVPKRVTFGAHTTFTELVAELQKQALEAEPHQYMPLYDIQSHIAAPNLIDHIIVFENYPLQEANKQHEEKNLGFTMDDITVFEKSNYDLNLLASPGEEMLLKLAYNRNVFEPSFILQLKEQLLTAIREIITNPEQPLDDICVVSKKEKERLLHEFNGQVQRKQTGLTIPQRFEQCAEALPEQPAVSAAGRTLTYRELNEQANKVAHLLRKKNVGRGEPVALLFRRSPEMVIAILAVLKAGGAYLPIDPEYPEARIQYMLEDSGAVCMLTQEELAGQAASLSFHQNTILIDDPAVSAESGRNLEIAAEPDDLAYIMYTSGTTGKPKGNLTTHANITRVVKETNYISLSEKDTLLSLSNYAFDGFTFDVYGALLNGAKLVVADQATILHIGKLTETIQKENITVMFVTTALFNLLVDAGTEWMKGIRKVLFGGERSSVSHVKKAFAAMGPDRIIHVYGPTETTVFATFYPVNRIEDNAVSIPIGKPINETNAYILTENNRLQPIGAVGELCLSGTGVSRGYLNRPELTAEKFVPHPFNSGETMYRTGDLARWLPDGNIDFIGRIDDQVKIRGHRIELGEIEEELMRCQGVKEAVVIAKKRGNGDAALTAYVVPVRGAVVSNEEVRRQLARNLPAYMVPDAYIMLEELPLTANGKVNRRLLPEADGRPNPTEHRAPRNMTEEKLAIIWSEVLGRQQIGIDENFFEIGGHSLKAMAVTSRMLKDLAIDVPVNVLFEMPTIEGLAAYIDQGGHADDVKKTVFNQESTRHLFAFPPVLGYGIVYGKLAEQMPEYKIHAFDFIESDDRAVRYAEAISGLQPEGPLTLIGYSAGCGLAFEVAQTLEKNGRKVEKLLMIDSYMKNGVSDLEGRSIEADTAALMEANKDNEYMKIKTVADGIAKKMAAYYSYFVNLVHQGTVSCEIHLIKSEHAKPLPEWLSTWKEGTESSYDEYQGAGRHDEMLADVFVKTNADLIRQILGERAAVIGGA

SEQ ID NO: 35 - DNA, 3342 bp, Artificial Sequence
  synthetic
atggaaataactttttaccctttaacggatgcacaaaaacgaatttggtacacagaaaaattttatcctcacacgagcatttcaaatcttgcggggattggtaagctggtttcagctgatgcgattgattatgtgcttgttgagcaggcgattcaagagtttattcgcagaaatgacgccatgcgccttcggttgcggctagatgaaaacggggagcctgttcaatatattagcgagtatcggcctgttgatataaaacatactgacactactgaagatccgaatgcgatagagtttatttcacaatggagccgggaggaaacgaagaaacctttgccgctatacgattgtgatttgttccgtttttccttgttcaccataaaggaaaatgaagtgtggttttacgcaaatgttcatcacgtgatttctgatggtatgtccatgaatattgtcgggaatgcgatcatgcacatttatttagaattagccagcggctcagagacaaaagaaggaatctcgcattcatttatcgatcatgttttatctgaacaggaatatgctcaatcgaagcggtttgaaaaggacaaggcgttttggaacaaacaatttgaatcggtgcctgaacttgtttccttgaaacggaatgcatccgcagggggaagtttagatgctgagaggttctctaaagatgtgcctgaagcgcttcatcagcagattctgtcgttttgtgaggcgaataaagtcagtgttctttcggtatttcaatcgctgctcgccgcctatttgtacagggtcagcggccagaatgatgttgtgacgggaacatttatgggcaaccggcaaaatgcgaaagagaagcagatgcttggcatgtttgtttctacggttccgcttcggacaaacattgacggcgggcaggcgttttcagaatttgtcaaagaccggatgaaggatctgatgaagacacttcgccaccaaaagtatccgtataatctcctaatcaacgatttgcgtgaaacaaagagctctctgaccaagctgttcacggtttctcttgaatatcaagtgatgcagtggcagaaagaagaggatcttgcctttttgactgagccgattttcagcggcagcggattaaatgatgtctcaattcatgtaaaggatcgatgggatactgggaaactcaccatagattttgattaccgcactgatttattttcacgtgaagaaatcaacatgatttgtgagcgcatgattaccatgctggagaacgcgttaacgcatccagaacatacaattgatgaattaacactgatttctgatgcggagaaagagaagctgcttgcgagggccggcggtaaatctgtgagctaccgtaaggacatgacgataccagagctgttccaagaaaaggctgaactgctttctgatcatccagcggttgtatttgaagatcgcacattgtcctatcgaacgttacatgagcaatctgcacgcatcgccaatgtgctgaaacagaaaggggttggcccggacagtcctgtcgcggttttgattgaacgctctgaacggatgattacagctatcatgggaattttaaaagccggcggagcctatgtggcgattgatccgggttttcctgctgagcgcattcaatatattttggaggactgcggggcggatttctacctgactgaatcgaaggttgcggcgcctgaagccgatgctgagctgattgacttagatcaggcgattgaggaaggtgcagaagaaagcctgaatgcagatgtgaacgctcggaaccttgcctacattatttacacatcgggaacaaccggacgcccgaaaggcgttatgatcgagcatcgccaggttcatcatttggttgaatctctgcagcagacgatttatcaaagccccacccaaaccctccccatggcattccttccgccgttccactttgatgcgtcagtgaagcagatcttcgcgtcgcttcttttgggccaaaccctttatatcgtaccgaagaaaacagtgacgaacggggccgcccttactgcatattatcggaagaacagcattgaggcgacggacggaacaccggctcatttgcaaatgctggcagcagcaggcgattttgaaggcctaaaactgaagcacatgctgatcggaggagaaggcctgtcatctgttgttgcggacaagctgctgaagctgtttaaagaagccggcacagcgccgcgtttgactaatgtgtacgggccgactgaaacgtgcgttgacgcgtctgttcatccggttatccctgagaatgcagttcaatcagcgtatgtgccgatcgggaaagcgctggggaataaccgcttatatattttggatcaaaaaggccggctgcagcctgaaggcgtggcgggtgagctttatatcgcgggagacggtgtgggccgaggctatttacatttgcctgaattaacggaagagaagtttttacaagatccattcgtgccgggcgatcgcatgtaccggaccggggacgtggtgcgctggcttccagatggaacaatcgaatatttaggcagagaggatgaccaggtcaaagtccgcggataccggattgagcttggggaaattgaagccgtgattcagcaggcgccagacgttgcaaaagccgttgttttggcacgccctgacgaacagggaaatcttgaggtttgcgcatatgttgtgcagaagcctggaagcgaatttgcgccagccggtttgagggagcatgcggccagacagcttcctgactatatggtgccggcttactttacagaagtgacagaaattccgcttacaccaagcggcaaagtcgaccgccgcaagctgtttgcactagaggtgaaggctgtcagcggcactgcctatacagcgccgcgaaatgagactgaaaaagcaatcgcagccatttggcaggacgtgctgaacgttgagaaggcggggatctttgacaatttctttgaaactggcggacattcattaaaagccatgacccttttaacaaagattcataaggaaacaggcattgagattccgcaacaatttttgtttgagcatccgacgattacggctcttgcagaggaagctgatcacagagaaagcaaagcttttgcggtgattgaacctgctgaaaaacaggagcattacccgcttcattggcacagcagcgaacatatatcgtcagccagttcgaggatgcgggagtcggctatacatgccagcagcagcaattctgaaggctttagatattcaaaagctggagcgcgcatttcagggattaatccgacgccacgagtcattgag

SEQ ID NO: 36 - protein, 1114 aa, Artificial Sequence
  synthetic
MEITFYPLTDAQKRIWYTEKFYPHTSISNLAGIGKLVSADAIDYVLVEQAIQEFIRRNDAMRLRLRLDENGEPVQYISEYRPVDIKHTDTTEDPNAIEFISQWSREETKKPLPLYDCDLFRFSLFTIKENEVWFYANVHHVISDGMSMNIVGNAIMHIYLELASGSETKEGISHSFIDHVLSEQEYAQSKRFEKDKAFWNKQFESVPELVSLKRNASAGGSLDAERFSKDVPEALHQQILSFCEANKVSVLSVFQSLLAAYLYRVSGQNDVVTGTFMGNRQNAKEKQMLGMFVSTVPLRTNIDGGQAFSEFVKDRMKDLMKTLRHQKYPYNLLINDLRETKSSLTKLFTVSLEYQVMQWQKEEDLAFLTEPIFSGSGLNDVSIHVKDRWDTGKLTIDFDYRTDLFSREEINMICERMITMLENALTHPEHTIDELTLISDAEKEKLLARAGGKSVSYRKDMTIPELFQEKAELLSDHPAVVFEDRTLSYRTLHEQSARIANVLKQKGVGPDSPVAVLIERSERMITAIMGILKAGGAYVAIDPGFPAERIQYILEDCGADFYLTESKVAAPEADAELIDLDQAIEEGAEESLNADVNARNLAYIIYTSGTTGRPKGVMIEHRQVHHLVESLQQTIYQSPTQTLPMAFLPPFHFDASVKQIFASLLLGQTLYIVPKKTVTNGAALTAYYRKNSIEATDGTPAHLQMLAAAGDFEGLKLKHMLIGGEGLSSVVADKLLKLFKEAGTAPRLTNVYGPTETCVDASVHPVIPENAVQSAYVPIGKALGNNRLYILDQKGRLQPEGVAGELYIAGDGVGRGYLHLPELTEEKFLQDPFVPGDRMYRTGDVVRWLPDGTIEYLGREDDQVKVRGYRIELGEIEAVIQQAPDVAKAVVLARPDEQGNLEVCAYVVQKPGSEFAPAGLREHAARQLPDYMVPAYFTEVTEIPLTPSGKVDRRKLFALEVKAVSGTAYTAPRNETEKAIAAIWQDVLNVEKAGIFDNFFETGGHSLKAMTLLTKIHKETGIEIPQQFLFEHPTITALAEEADHRESKAFAVIEPAEKQEHYPLHWHSSEHISSASSRMRESAIHASSSNSEGFRYSKAGARISGINPTPRVIE

SEQ ID NO: 37 - DNA, 3030 bp, Artificial Sequence
  synthetic
catgccagcagcagcaattctgaaggctttagatattcaaaagctggagcgcgcatttcagggattaatccgacgccacgagtcattgagacatcatttgttcttgaaaacagcacgccgagacagaaaattcacgtatgcgttgatttcaacatcgaaatgattgaaagaggcggccgctcagatgaggcaattatggcttcattcgttcggacatttgatttggcgaaagctccgctgttcagaatcggtttgctggggcttgaagagaaccgtcatatgctgctgtttgacatgcaccatttgatttctgacggtgtatccattggcattatgctggaggagttagcacgcatttataaaggcgaacagcttcctgatcttcgtctccagtataaggactacgctgtatggcaaagcagacaggctgctgaagggtacaagaaggaccaggcttattggaaggaagtctttgcaggcgagctcccggtgcttcagcttctgtccgattacccaagaccacctgttcaaagctttgaaggggatcgggtgtcaatcaagctggatgcgggggtaaaggatcgcctcaatcgtttggctgaacaaaacggcgccactttatatatggtgatgctttccgcttactatacgcttttgtcaaagtatacggggcaggatgacatcattgtcgggacaccgtcagcgggcagaaatcactccgatacagagggcattatcgggatgttcgtcaatacgcttgcgattcgcagtgaggtgaagcagaatgagacgtttacccaattgatctcgcgtgtccgcaaacgggtgctggatgccttttctcatcaggactatccgtttgagtggcttgttgaagatttgaacatcccgcgtgatgttagcaggcatccgctgtttgacacgatgttcagccttcaaaacgcgacagagggcattccggctgtcggcgatctttccttgtctgttcaagagaccaatttcaagattgccaaatttgatttgacggtgcaggcgagagaaaccgatgaaggcattgagattgatgtggattacagcacaaagctgtttaaacaaagcacggcagacaggctgcttacgcattttgcgcgtttgcttgaagatgctgcggctgatccagagaagccgatttctgagtataagcttctttctgaagaggaggctgcttcgcaaattcagcagtttaacccgggcagaacaccttatccgaaagataaaacaattgttcagctgtttgaggagcaagcggcgaatacgccagaccacactgcgcttcaatatgaaggcgaatcactcacttatcgtgaactgaatgaacgggccaatcgtttagcccgcggcattctttctcttggagctggcgaaggcagaactgcggctgtcttatgcgagcggtcaatggatatgattgtgtcgatcttggcagtattaaaatcaggttcggcttatgttccgatcgatccggaacatccgattcagcggatgcagcatttcttccgtgacagcggagcaaaggtgcttctcactcagaggaaattaaaggctttggcggaagaagcggaatttaagggcgttatcgtgctagccgatgaggaagaaagctatcatgccgatgcgcgaaatctcgcactgcctcttgattctgcagcaatggccaacctgacgtatacttccggaacgactggaacacctaaggggaatatcgtgacacatgccaatattctccgcacggtgaaggaaacgaattatctcagcattacagaacaggatacgattctcggtctttccaattacgtgtttgacgcgtttatgttcgatatgttcggctctttgttaaacggagccaagctggtgctgataccgaaggaaaccgttttggacatggctcgcctgtcccgcgtcattgaacgggagaacatcagcattctcatgattacaaccgctttgttccacttgcttgtggacttgaatccggcatgcttgtcaacgcttcgcaagattatgtttggcggggaacgggcttcggttgagcatgtcagaaaagctttgcaaacggttggaaagggcaagctccttcatatgtatggaccgtctgaaagcacggttttcgcgacgtatcatccggttgatgaattggaggagcacacgctgtctgttccgattggaaaaccggtcagcaatacggaagtatacattcttgaccgtacgggacacgtgcagcctgccgggattgccggagagctttgcgtcacgggcgaaggactcgtgaaaggctattacaaccgtccagaactgactgaggagaaatttgttccccatccgtttacatccggcgaacgcatgtataaaacgggagaccttgcgagatggctgccgaatgggaccatcgaatttatcgggcgaatcgaccatcaggtgaagattcgcggacaggccatcgagcttggagaaatcgaacatcagctgcaaacccatgatcgtgttcaggaaagtgttgtgcttgccgttgatcaaggagcgggagataaactgttgtgtgcttactatgtcggagaaggagacatctcatcacaagagatgagagagcatgctgcgaaggacttgccggcatatatggttcctgcggtgtttatccaaatggacgagctgccgctgacagggaacggaaaaattgaccggagagcgctgccgattcctgatgccaacgtttcaagaggtgtttcatatgttgcgccacgcaatggaacggaacaaaaagtcgcggacatttgggcacaggtacttcaggcagaacaagtcggcgcttatgaccacttctttgacattggcggacattcattagcaggcatgaagatgcctgccttggttcatcaggaactgggcgttgagctgtcactcaaggatctcttccagtcaccgacggttgagggcttggcacaggtgattgcctctgctgaaaaagggacagccgcaagtatcagcccggcagag

SEQ ID NO: 38 - protein, 1010 aa, Artificial Sequence
  synthetic
HASSSNSEGFRYSKAGARISGINPTPRVIETSFVLENSTPRQKIHVCVDFNIEMIERGGRSDEAIMASFVRTFDLAKAPLFRIGLLGLEENRHMLLFDMHHLISDGVSIGIMLEELARIYKGEQLPDLRLQYKDYAVWQSRQAAEGYKKDQAYWKEVFAGELPVLQLLSDYPRPPVQSFEGDRVSIKLDAGVKDRLNRLAEQNGATLYMVMLSAYYTLLSKYTGQDDIIVGTPSAGRNHSDTEGIIGMFVNTLAIRSEVKQNETFTQLISRVRKRVLDAFSHQDYPFEWLVEDLNIPRDVSRHPLFDTMFSLQNATEGIPAVGDLSLSVQETNFKIAKFDLTVQARETDEGIEIDVDYSTKLFKQSTADRLLTHFARLLEDAAADPEKPISEYKLLSEEEAASQIQQFNPGRTPYPKDKTIVQLFEEQAANTPDHTALQYEGESLTYRELNERANRLARGILSLGAGEGRTAAVLCERSMDMIVSILAVLKSGSAYVPIDPEHPIQRMQHFFRDSGAKVLLTQRKLKALAEEAEFKGVIVLADEEESYHADARNLALPLDSAAMANLTYTSGTTGTPKGNIVTHANILRTVKETNYLSITEQDTILGLSNYVFDAFMFDMFGSLLNGAKLVLIPKETVLDMARLSRVIERENISILMITTALFHLLVDLNPACLSTLRKIMFGGERASVEHVRKALQTVGKGKLLHMYGPSESTVFATYHPVDELEEHTLSVPIGKPVSNTEVYILDRTGHVQPAGIAGELCVTGEGLVKGYYNRPELTEEKFVPHPFTSGERMYKTGDLARWLPNGTIEFIGRIDHQVKIRGQAIELGEIEHQLQTHDRVQESVVLAVDQGAGDKLLCAYYVGEGDISSQEMREHAAKDLPAYMVPAVFIQMDELPLTGNGKIDRRALPIPDANVSRGVSYVAPRNGTEQKVADIWAQVLQAEQVGAYDHFFDIGGHSLAGMKMPALVHQELGVELSLKDLFQSPTVEGLAQVIASAEKGTAASISPAE

SEQ ID NO: 39 - DNA, 4572 bp, Artificial Sequence
  synthetic
gatctcttccagtcaccgacggttgagggcttggcacaggtgattgcctctgctgaaaaagggacagccgcaagtatcagcccggcagagaaacaagatacgtatcctgtttcttcaccgcaaaaacggatgtacgtgcttcagcagcttgaggatgcgcaaacgagctataacatgccggcggttctgcgcctgacaggtgagcttgatgttgaaaggcttaacagcgtcatgcagcagttaatgcagcgtcatgaagccttgagaaccacgtttgaaataaaagatggagaaacggtgcagcggatctgggaagaggctgagtgcgagatagcctatttcgaagccccggaagaagagacagagcggatcgtttctgagtttattaagcctttcaaaatcgaccaacttccactgttcagaatagggcttatcaagcattcagacactgagcaggtgctgctgttcgatatgcatcatattatttctgatggtgcatctgtcggtgtgctgattgaggagctttcaaagctgtacgacggagaaacccttgagccgctccgtattcaatataaggattatgccgtgtggcagcacaggttcattcagtctgagctttacaagaagcaagaagagcattggctgaaggagctcgacggagagctgccggtgctgacgcttccgactgattacagtcggcctgccgttcaaacatttgagggagaccgcattgcattttcattagaagcaggcaaagctgatgctctgcgcaggcttgcaaaagaaacggattccacgctttacatggtgcttctggcttcatacagtgcgtttttatcaaaaatttgcgggcaagacgatatcatcgtcggttcacctgtggccggacgatctcaagcggacgtcagccgcgtcatcggaatgttcgtcaatacattggcgctgcgcacgtatccgaagggtgaaaagacgtttgctgactatcttaacgaagtgaaagaaactgcactcagcgcttttgatgcgcaggattacccacttgaggatttgatcggaaatgttcaggttcagcgtgacacaagcagcaatccgttattcgatgcagttttttcaatgcaaaatgcgaatataaaggatttaacaatgaaagggattcagcttgagccgcatccgtttgaacggaaaacagccaagtttgacctcacgctgacggctgacgaaaccgacggagggcttacattcgtactcgaatacaatacagctctgtttaagcaggaaacgattgaacgatggaagcaatattggatggagcttttagatgcagttactgggaacccgaaccagccgctttccagcctgtcactggtcaccgagacagaaaagcaagcgcttcttgaggcttggaagggcaaagcgctgcctgtgccgacagacaaaacggttcatcagctattcgaagagactgcccagcgccacaaagaccgcccggctgtcacatacaacggccagtcttggacgtacggcgagctgaatgcgaaggcaaaccgtctcgcgcggattctgatggactgcggcatcagcccggatgaccgcgtcggcgttctcacgaagccgtcgcttgaaatgtccgccgcggtgctcggcgtcttgaaagccggagcggcgtttgtgccgattgatcctgactatccggatcagcggattgagtatattttacaggacagcggcgcgaagcttctcttgaaacaggaaggcatttcagtgccggacagctatacgggagatgtcattcttctcgacggaagccgcacgattctaagcctgccgcttgatgaaaacgacgaggaaaatccagaaaatccagaaaccgctgtaaccgcggagaacttggcgtacatgatttacacgtctggaacgaccggacagccgaagggtgtcatggtcgagcaccatgcgcttgtgaacctgtgcttctggcaccacgacgcgttcagcatgacagcggaggaccgcagtgcgaagtacgcgggctttgggttcgacgcttccatttgggagatgttcccgacctggagcatcggtgccgaacttcacgtcattgaggaagcgatccgcctcgatatcgtccgcctgaacgattattttgaaacgaacggcgtaacgatcacgttcctgccgacacagcttgcggaacagttcatggagcttgagaacacatcacttcgcgtattgcttactggaggagacaagctgaagcgcgcagtgaaaaagccgtacacactcgtcaataactacgggccgacagagaatacggtcgttgccacaagcgcagaaatccatccggaggaaggctcgctttccatcggaagggccattgccaatacgagagtatacattctcggcgagggcaatcaggtgcagccggaaggcgtagccggagagctttgcgtggcggggcgcggactggcacgcggctatctgaatcgagaagacgaaaccgcgaagcggtttgtcgctgatccgtttgtgccgggtgagcgcatgtaccgcaccggcgatttggtgaaatggacgggcggcggcatcgaatacatcgggcggatcgaccagcaggtcaaggtccgcggctaccggatcgagctctcagaaattgaagtccagctcgcccagctttctgaggtgcaggatgcggcggtgacagctgtcaaagataaaggcggcaacacagcgatcgcggcgtatgtcacaccggaatcagctgacatagaagcactgaaatcagcactgaaggaaaccctgccggattacatgatcccggcgttctgggtgacgctgaacgagcttccggttacggcaaacggcaaagtggaccgcaaagccttgaatgagccggacatcgaagcgggaagcggagaatacaaagcgccgacgaccgacatggaagagctgcttgccggcatctggcaggacgtgcttggaatgtctgaagtcggtgtcaccgacaatttcttctcgcttggcggagattccatcaaaggaattcaaatggcgagccgcttgaaccagcacggctggaagctggaaatgaaagatctcaaccagcacccgacgatcgaagagctcacccagtacgtagagcgtgccgaaggcaaacaggcagaccaaggcccggtggagggcgaagtcatcctgacgccgatccagcgctggttctttgaaaagaacttcacgaacaagcaccactggaaccaatctgtgatgcttcacgccaagaagggctttgatcctgaacgggtggagaaaacattgcaggcgctgatcgagcatcatgacgcgctccgcatggtctatcgtgagggacaggaagacgtcattcaatacaacagaggtcttgaagctgcttcagctcaattggaggtcatccagattgagggccaagctgcagattacgaagaccgaatagagagagaagcggagcgtttgcaaagcagcatcgacttgcaggaaggcggcttgttaaaagcaggcttgttccaagcggaagacggagatcacttgcttcttgccattcaccacttagtggttgacggcgtgtcgtggcggattttactggaggatttctccgcggtatatacacagcttgagcaaggcaatgaaccggttctcccgcagaaaacacattcatttgcagagtatgcagagagattgcaagacttcgcgaactccaaagcctttttgaaagaaaaagagtattggtcacagcttgaagaacaagctgttgcggcaaagcttccgaaagaccgcgaatctggtgatcagcgaatgaaacatacaaagacaattgaattctcgctgactgctgaagagacagaacagctcaccacaaaggtgcatgaggcatatcacacagaaatgaatgatattttgctgacggcattcggattggcaatgaaggagtggacgggtcaagatcgagtaagtgttcatttagaggggcatggacgtgaagaaatcatagaagacctgaccatttctcgcacagtcggctggtttacaagtatgtacccaatggtgctcgatatgaagcatgcggatgatctgggctaccagctgaagcaaatgaaagaagatatcagacatgtgccgaataagggagtcggatcaggcattctgcgctatctgacggcaccggaacataaagaagatgtggcgttctcgattcagccggatgtcagcttcaactatttaggtcagtttcaccaaatgtcccatccacctttctttaccacatcacacctcccatcaccacactcattaagccctgaaacagaaaaaccgaatgcgctggatgttgtcggatatatcgaaaacggaaaactgacgatgtcactggcctatcattctcttgaatttcatgaaaaaacagtacaaacattcagtgacagctttaaagcgcatcttctcagaatcattgaacattgcctatctcaagatggtacggaactgaccccgagtgatcttggtgacgacgatttgacgctggatgagctggataaattaatggaaattttc

SEQ ID NO: 40 - protein, 1524 aa, Artificial Sequence
  synthetic
DLFQSPTVEGLAQVIASAEKGTAASISPAEKQDTYPVSSPQKRMYVLQQLEDAQTSYNMPAVLRLTGELDVERLNSVMQQLMQRHEALRTTFEIKDGETVQRIWEEAECEIAYFEAPEEETERIVSEFIKPFKIDQLPLFRIGLIKHSDTEQVLLFDMHHIISDGASVGVLIEELSKLYDGETLEPLRIQYKDYAVWQHRFIQSELYKKQEEHWLKELDGELPVLTLPTDYSRPAVQTFEGDRIAFSLEAGKADALRRLAKETDSTLYMVLLASYSAFLSKICGQDDIIVGSPVAGRSQADVSRVIGMFVNTLALRTYPKGEKTFADYLNEVKETALSAFDAQDYPLEDLIGNVQVQRDTSSNPLFDAVFSMQNANIKDLTMKGIQLEPHPFERKTAKFDLTLTADETDGGLTFVLEYNTALFKQETIERWKQYWMELLDAVTGNPNQPLSSLSLVTETEKQALLEAWKGKALPVPTDKTVHQLFEETAQRHKDRPAVTYNGQSWTYGELNAKANRLARILMDCGISPDDRVGVLTKPSLEMSAAVLGVLKAGAAFVPIDPDYPDQRIEYILQDSGAKLLLKQEGISVPDSYTGDVILLDGSRTILSLPLDENDEENPENPETAVTAENLAYMIYTSGTTGQPKGVMVEHHALVNLCFWHHDAFSMTAEDRSAKYAGFGFDASIWEMFPTWSIGAELHVIEEAIRLDIVRLNDYFETNGVTITFLPTQLAEQFMELENTSLRVLLTGGDKLKRAVKKPYTLVNNYGPTENTVVATSAEIHPEEGSLSIGRAIANTRVYILGEGNQVQPEGVAGELCVAGRGLARGYLNREDETAKRFVADPFVPGERMYRTGDLVKWTGGGIEYIGRIDQQVKVRGYRIELSEIEVQLAQLSEVQDAAVTAVKDKGGNTAIAAYVTPESADIEALKSALKETLPDYMIPAFWVTLNELPVTANGKVDRKALNEPDIEAGSGEYKAPTTDMEELLAGIWQDVLGMSEVGVTDNFFSLGGDSIKGIQMASRLNQHGWKLEMKDLNQHPTIEELTQYVERAEGKQADQGPVEGEVILTPIQRWFFEKNFTNKHHWNQSVMLHAKKGFDPERVEKTLQALIEHHDALRMVYREGQEDVIQYNRGLEAASAQLEVIQIEGQAADYEDRIEREAERLQSSIDLQEGGLLKAGLFQAEDGDHLLLAIHHLVVDGVSWRILLEDFSAVYTQLEQGNEPVLPQKTHSFAEYAERLQDFANSKAFLKEKEYWSQLEEQAVAAKLPKDRESGDQRMKHTKTIEFSLTAEETEQLTTKVHEAYHTEMNDILLTAFGLAMKEWTGQDRVSVHLEGHGREEIIEDLTISRTVGWFTSMYPMVLDMKHADDLGYQLKQMKEDIRHVPNKGVGSGILRYLTAPEHKEDVAFSIQPDVSFNYLGQFHQMSHPPFFTTSHLPSPHSLSPETEKPNALDVVGYIENGKLTMSLAYHSLEFHEKTVQTFSDSFKAHLLRIIEHCLSQDGTELTPSDLGDDDLTLDELDKLMEIF

SEQ ID NO: 41 - DNA, 3159 bp, Artificial Sequence
  synthetic
atgagcaaaaaatcgattcaaaaggtgtacgcactgacaccaatgcaggagggaatgctgtatcatgcgatgcttgatccgcattcttcctcgtactccacacaattagagcttgggattcacgccgcttttgatcttgaaatctttgagaaaagcgtcaatgaactgattcggtcatacgatattctccgtacggtatttgtgcatcagcagctgcaaaaaccgcgtcaggtcgtgttagcggaacgcaaaacaaaagtgcattatgaggatatcagtcatgcagacgaaaaccgccagaaagagcacattgagcgttacaaacaacaggttcagcgccaagcctttaacctggcaaaagacatattgttcaaggtagcggttttccgccttgctgcagatcagctgtatcttgcttggagcaatcatcatattatgatggacggctggagcatgggcgtcctcatgaaaagcctgttccaaaactatgaagcgctcagagcaggcaggacaccggcaaacggtcagggcaagccttattccgattacatcaagtggcttggaaaacaggacaatgaagaagcggagagctactggagcgagcgcttggcgggttttgaacagccaagcgtgctcccgggccgcctgcctgtgaaaaaagacgaatacgtcaataaagaatattcatttacatgggacgaaacactggttgcccgtattcagcaaaccgcaaatctccatcaagtgacagggcctaacctatttcaggccgttttgggcattgttctcagcaaatacaactttacggatgatgtgatcttcggaacggtcgtctcgggacgaccgtctgaaatcaacggaatcgaaacgatggcggggctgtttatcaacaccattccagtgcgggtgaaagttgaacgagatcgtgcattcgctgatattttcacagctgttcagcagcatgcagtagaggcagagcgttacgattacgtgccgctctatgagattcaaaaacgctcagctcttgatggcaatctcttaaaccatctggtcgcgtttgaaaattatccgcttgatcaagagcttgaaaacggcagcatggaagaccgcctcgggttttcgattaaggtagaaagcgcatttgaacaaacgagcttcgatttcaacctgattgtgtatccgggcaaaacgtggaccgtcaaaattaaatataacggagccgcctttgattccgcttttatcgaacggacagcggagcaccttacccgcatgatggaagcagctgtcgatcagccggccgcttttgtgcgtgagtacgggcttgtgggagacgaagagcagcggcaaattgtcgaggtgtttaacagcacgaaagccgaactccctgaaggaatggctgttcaccaagtgtttgaagagcaagcgaaacggacgccggcgagcaccgccgtcgtatatgaaggaaccaagctgacgtaccgcgagctgaatgcagcggctaaccgtctggcgagaaagcttgtcgaacatgggcttcaaaaaggggaaacagcagcgattatgaacgaccgctcagtagaaaccgttgtcggcatgctggctgttttaaaagcaggcgccgcatatgtgccgcttgatccagcgcttcctggggatcgtcttcgtttcatggcagaggacagctccgttcgaatggttttgatcggaaattcttatacagggcaggcacatcagctgcaagtgccggttcttacactggacataggctttgaagagagtgaagcggctgacaatctcaacctgccatccgccccgtctgatttggcgtacatcatgtacacatccggttcaacgggcaaaccgaaaggcgtcatgatcgaacataaaagcattctgcgcctcgtcaaaaatgccgggtacgttcctgttactgaagaagacgcaatggcgcaaacgggagctgtcagctttgatgccggaacgtttgaggtattcggcgcactgctgaatggcgcagcactttatccggtcaaaaagagacacgtgcttgatgcgaaacaatttgctgcattcctgcgtgagcaaagcatcacaactatgtggctgacatcacctttattcaaccagcttgctgcaaaggatgcgggtatgttcggcacactgcgccatttaatcatcggcggagatgcccttgtcccgcatattgtcagcaaagtaaaacaggcatcgccgtcgctttcattgtggaacggatacggcccgacagaaaacacgacgttttcaaccagttttctgatcgaccgcgagtatggcggctctatcccaatcgggaagccgatcggaaattccactgcctatattatggatgagcagcaatgcctgcagccaatcggcgcgcctggtgagctttgcgtaggcggaatcggtgtagcgcgtgggtatgtcaatctccctgagctgacggagaagcaatttctggaagacccgttcagaccgggtgagagaatttaccgcactggtgacttggcaagatggctgccggacggcaatatcgaatttttaggcagaatcgacaaccaagtgaaggtgcgcggcttccgaattgagcttggcgaaattgaaacaaaactgaacatggctgagcatgtgacagaagccgcggtgatcatacgcaagaacaaagcagacgaaaatgaaatttgcgcgtacttcacggcggatcgtgaagtggctgtgagtgagctgagaaaaacactgtctcagtctttgcctgactatatggtccctgcccacctgattcaaatggacagcctgccgctcacgccaaacgggaaaatcaacaaaaaggaactgcctgcaccgcaatcagaagccgtgcagccggaatacgcagcaccaaaaacagagagtgaaaagaaattagcggagatctgggaaggaatactcggcgtcaaagcaggcgttaccgataacttctttatgatcggcggccattctttgaaagcgatgatgatgacggcgaaaattcaagagcattttcataaggaagttccgataaaagtgctttttgaaaagccgactattcaagaactggcactgtatttggaagagaacgaaagcaaggaggagcagacgtttgaaccgatcaggcaagcatct

SEQ ID NO: 42 - protein, 1053 aa, Artificial Sequence
  synthetic
MSKKSIQKVYALTPMQEGMLYHAMLDPHSSSYSTQLELGIHAAFDLEIFEKSVNELIRSYDILRTVFVHQQLQKPRQVVLAERKTKVHYEDISHADENRQKEHIERYKQQVQRQAFNLAKDILFKVAVFRLAADQLYLAWSNHHIMMDGWSMGVLMKSLFQNYEALRAGRTPANGQGKPYSDYIKWLGKQDNEEAESYWSERLAGFEQPSVLPGRLPVKKDEYVNKEYSFTWDETLVARIQQTANLHQVTGPNLFQAVLGIVLSKYNFTDDVIFGTVVSGRPSEINGIETMAGLFINTIPVRVKVERDRAFADIFTAVQQHAVEAERYDYVPLYEIQKRSALDGNLLNHLVAFENYPLDQELENGSMEDRLGFSIKVESAFEQTSFDFNLIVYPGKTWTVKIKYNGAAFDSAFIERTAEHLTRMMEAAVDQPAAFVREYGLVGDEEQRQIVEVFNSTKAELPEGMAVHQVFEEQAKRTPASTAVVYEGTKLTYRELNAAANRLARKLVEHGLQKGETAAIMNDRSVETVVGMLAVLKAGAAYVPLDPALPGDRLRFMAEDSSVRMVLIGNSYTGQAHQLQVPVLTLDIGFEESEAADNLNLPSAPSDLAYIMYTSGSTGKPKGVMIEHKSILRLVKNAGYVPVTEEDAMAQTGAVSFDAGTFEVFGALLNGAALYPVKKRHVLDAKQFAAFLREQSITTMWLTSPLFNQLAAKDAGMFGTLRHLIIGGDALVPHIVSKVKQASPSLSLWNGYGPTENTTFSTSFLIDREYGGSIPIGKPIGNSTAYIMDEQQCLQPIGAPGELCVGGIGVARGYVNLPELTEKQFLEDPFRPGERIYRTGDLARWLPDGNIEFLGRIDNQVKVRGFRIELGEIETKLNMAEHVTEAAVIIRKNKADENEICAYFTADREVAVSELRKTLSQSLPDYMVPAHLIQMDSLPLTPNGKINKKELPAPQSEAVQPEYAAPKTESEKKLAEIWEGILGVKAGVTDNFFMIGGHSLKAMMMTAKIQEHFHKEVPIKVLFEKPTIQELALYLEENESKEEQTFEPIRQAS

SEQ ID NO: 43 - DNA, 3222 bp, Artificial Sequence
  synthetic
gaaaagccgactattcaagaactggcactgtatttggaagagaacgaaagcaaggaggagcagacgtttgaaccgatcaggcaagcatcttatcagcagcattatcctgtatccccggcccagcggagaatgtatatcctcaatcagcttggacaagcaaacacaagctacaacgtccccgctgtacttctgctggagggagaagtagataaagaccggcttgaaaacgcaattcagcaattaatcaaccggcacgaaatcctccgtacatcgtttgacatgatcgacggagaggttgtgcaaaccgttcataaaaacatatccttccacctggaggctgccaagggacgggaagaagacgcggaagagataatcaaagcatttgttcagccgtttgaattaaaccgcgcgccgctcgtccgttcgaagcttgtccagctggaagaaaaacgccacctgctgctcattgatatgcatcatattattactgacggaagttcaacaggcattctaatcggtgatcttgccaaaatatatcaaggcgcagatctggaactgccacaaattcactataaagattacgcagtttggcacaaagaacaaactaattatcaaaaagatgaggaatactggctcgatgtctttaaaggcgaactgccaatactggatcttcccgcggatttcgagcggccagctgaacggagctttgcgggagagcgcgtgatgtttgggcttgataagcaaatcacggctcaaatcaaatcgctcatggcagaaacagatacgacaatgtacatgtttttgctggcggcgttcaatgtactcctttccaagtacgcgtcacaggatgatatcattgtcggctcgccgacagctggcagaacacatcctgatctgcaaggtgtgccgggtatgtttgtcaacacgggggcactaagaacggcaccagcgggagataaaaccttcgcgcaattccttgaagaggtcaaaacagccagccttcaagcattcgagcaccagagctatccgcttgaggagctgattgaaaagcttccgcttacaagggatacaagcagaagtccgctgttcagcgtgatgttcaacatgcagaatatggagattccttcattaagattaggagatttgaagatttcctcgtattccatgcttcatcatgttgcgaaatttgatctttccttggaagcggtcgagcgtgaagaggatatcggcctaagctttgactatgcgactgccttgtttaaggacgagacgatccgccgctggagccgccactttgtcaatatcatcaaagcggccgcggctaatccgaacgttcggctgtctgatgtagatctgctttcatctgcagaaacggctgctttgctagaagaaagacatatgactcaaattaccgaagcaacctttgcagcactttttgaaaaacaggcccagcaaacacctgaccattctgcggtgaaggctggcggaaatctgttgacctatcgtgagcttgatgaacaggcgaaccagctggcgcatcatcttcgtgcccaaggggcaggaaatgaagacatcgtcgcgattgttatggaccggtcagctgaagtcatggtatccattctcggtgtcatgaaggcgggggcagctttccttccgattgatcctgatacacctggagaacgaatccgttattcattagaggacagcggagcaaaatttgcggtcgtgaatgaaagaaacatgacggctattgggcaatatgaagggataattgtcagccttgatgacggtaaatggagaaatgaaagcaaggagcgcccatcatccatttccgggtctcgcaatcttgcatacgtcatttatacgtccggtacgaccggaaagccaaagggcgtgcagattgagcatcgtaatctgacaaactatgtctcttggtttagtgaagaggcgggcctgacgaagaggcgggctgacggaaatgataagactgtattgctttcatcttacgcatttgaccttggctatacgtgcatgttccctgtacttctgggcgggggcgagctccatatcgtccagaaggaaacctatacggcgccggatgaaatagcgcactatatcaaggagcatgggatcacttatatcaagctgacaccgtctctgttccatacaatagtgaacaccgccagttttgcttttgatgcgaactttgaatccttgcgcttgatcgtcttgggaggagaaaaaatcatcccgactgatgttatcgccttccgtaagatgtatggacataccgaatttatcaatcactacggcccgacagaagcaacgatcggcgccatcgccgggcgggttgatctgtatgagccggatgcatttgcgaaacgcccgacaatcggacgcccgattgcgaatgccggtgcgcttgtcttaaatgaagcattgaagcttgtgccgcctggagcgagcggacagctctatatcacgggacaggggctcgcgagagggtatctcaacaggcctcagctgacagccgagagatttgtagaaaatccatattcgccgggaagcctcatgtacaaaaccggagatgtcgtacgaagactttctgacggtacgcttgcatttatcggccgggctgatgatcaggtgaaaatccgaggctaccgcattgagttgggagaaattgaaacggtcatgctcagcctcagcggaattcaagaagcggttgtactagcggtttccgagggcggtcttcaagagctttgcgcgtattatacgtcggatcaagatattgaaaaagcagagctccggtaccagctttccctaacactgccgtctcatatgattcctgctttctttgtgcaggttgacgcgattccgctgacggcaaacggaaaaaccgacagaaacgctctgccgaagcctaacgcggcacaatccggaggcaaggccttggccgcaccggagacagcgcttgaagaaagtttatgccgcatttggcagaaaacgcttggcatagaagccatcggcattgatgacaattttttcgatttaggcggccattcattaaaagggatgatgctgattgccaacattcaggcggaattggagaaaagcgtaccgcttaaagcactgttcgagcagccgacagttcgccagctggcggcttatatggaggcgtctgctgtttcaggcggccatcaagtactcaaaccggctgac

SEQ ID NO: 44 - protein, 1074 aa, Artificial Sequence
  synthetic
EKPTIQELALYLEENESKEEQTFEPIRQASYQQHYPVSPAQRRMYILNQLGQANTSYNVPAVLLLEGEVDKDRLENAIQQLINRHEILRTSFDMIDGEVVQTVHKNISFHLEAAKGREEDAEEIIKAFVQPFELNRAPLVRSKLVQLEEKRHLLLIDMHHIITDGSSTGILIGDLAKIYQGADLELPQIHYKDYAVWHKEQTNYQKDEEYWLDVFKGELPILDLPADFERPAERSFAGERVMFGLDKQITAQIKSLMAETDTTMYMFLLAAFNVLLSKYASQDDIIVGSPTAGRTHPDLQGVPGMFVNTGALRTAPAGDKTFAQFLEEVKTASLQAFEHQSYPLEELIEKLPLTRDTSRSPLFSVMFNMQNMEIPSLRLGDLKISSYSMLHHVAKFDLSLEAVEREEDIGLSFDYATALFKDETIRRWSRHFVNIIKAAAANPNVRLSDVDLLSSAETAALLEERHMTQITEATFAALFEKQAQQTPDHSAVKAGGNLLTYRELDEQANQLAHHLRAQGAGNEDIVAIVMDRSAEVMVSILGVMKAGAAFLPIDPDTPGERIRYSLEDSGAKFAVVNERNMTAIGQYEGIIVSLDDGKWRNESKERPSSISGSRNLAYVIYTSGTTGKPKGVQIEHRNLTNYVSWFSEEAGLTKRRADGNDKTVLLSSYAFDLGYTCMFPVLLGGGELHIVQKETYTAPDEIAHYIKEHGITYIKLTPSLFHTIVNTASFAFDANFESLRLIVLGGEKIIPTDVIAFRKMYGHTEFINHYGPTEATIGAIAGRVDLYEPDAFAKRPTIGRPIANAGALVLNEALKLVPPGASGQLYITGQGLARGYLNRPQLTAERFVENPYSPGSLMYKTGDVVRRLSDGTLAFIGRADDQVKIRGYRIELGEIETVMLSLSGIQEAVVLAVSEGGLQELCAYYTSDQDIEKAELRYQLSLTLPSHMIPAFFVQVDAIPLTANGKTDRNALPKPNAAQSGGKALAAPETALEESLCRIWQKTLGIEAIGIDDNFFDLGGHSLKGMMLIANIQAELEKSVPLKALFEQPTVRQLAAYMEASAVSGGHQVLKPAD

SEQ ID NO: 45 - DNA, 4560 bp, Artificial Sequence
  synthetic
ctgttcgagcagccgacagttcgccagctggcggcttatatggaggcgtctgctgtttcaggcggccatcaagtactcaaaccggctgacaagcaggatatgtatccattgtcatccgcacagaaacgaatgtacgtgctcaatcagcttgaccgccagacgataagctacaacatgccatctgttcttctaatggaaggagagcttgatatttggcctgcgcgactcactcctcagcttgtgaaccgtcacgaatcattgcggacgtcatttatggaagctaatggtgagcctgttcagcgcatcattgagaaggcggaggttgatcttcatgtgtttgaagccaaagaagacgaagcggaccaaaagattaaggaatttatccggccattcgacttaaacgacgcaccgctcattcgcgcagctttgcttcgaatagaagcgaaaaaacatttgctgcttttagatatgcatcatatcatcgcagacggcgtctcaagaggcatctttgtaaaagaattggcgctgctttacaaaggagagcagcttccggagccgacgcttcattataaagatttcgccgtttggcaaaatgaagctgagcaaaaagaacggatgaaggagcatgaggcgtactggatgtcagttctttcaggcgagctgccagagcttgatctcccgctcgattatgcccgtccgcctgtgcaaagctttaaaggagatacgatccgtttccgtacgggaagtgagacggcaaaggcggtagaaaaactgcttgccgaaaccggaacgaccttgcacatggtgctccatgctgttttccacgtctttttaagcaaaatttccggacagcgggatatcgtcatcggctccgttactgccggccggacgaatgctgatgttcaggacatgccgggaatgttcgtcaatacacttgccctgagaatggaagcgaaagaacagcaaacatttgcggagcttttggagctagcaaagcagacgaacctgtcagcccttgagcatcaggagtatccgtttgaagatctggttaatcagcttgatctccctcgggatatgagccgaaacccattgtttaatgtgatggtgacgacagaaaaccctgataaagaagagcttacattgcaaaatctgagcatttcaccttatgaggctcatcagggaacttctaagtttgatctgacactgggcggatttactgatgaaaatggcattggcttgcagctcgaatatgcgacagatctgttcgcaaaagaaacagctgaaaaatggagcgaatacgttctgcggctactaaaggctgttgcggataacccgaaccagccgctttccagtctgttactggtcaccgagacagaaaagcaagcgcttcttgaggcatggaagggcaaagcgctgcctgtgccgacagacaaaacggttcatcagctattcgaagagactgtccagcgccacaaagaccgcccggctgtcacatacaacggccaatcttggacgtacggcgagctgaacgcgaaggcaaaccgcctcgcccggattctgatggactgcggcatcagcccggatgaccgcgtcggcgttctcacgaagccgtcgcttgaaatgtccgccgcggtgctcggcgtcttgaaagccggagcggcgtttgtgccgattgatcctgactacccggatcagcggattgagtatattttacaggacagcggcgcgaagcttctcttgaaacaggaaggcatttcagtgccggacagctatacgggagatgtcattcttctcgacggaagccgcacgattctaagcctgccgcttgatgaaaacgacgagggaaatccagaaaccgctgtaaccgcggagaacttggcgtacatgatttacacgtctggaacgaccggacagccgaagggtgtcatggtcgaggaccatgcgcttgtgaacctgtgcttctgggaccacgacgcgttcagcatgacagcggaggaccgcagtgcgaagtacgcgggcttcgggttcgacgcttccatttgggagatgttcccgacctggacgatcggcgctgaacttcacgtcattgatgaagcgatccgcctcgatatcgtccgcctgaacgattattttgaaacgaacggcgtaacgatcacgttcctgccgacacagcttgcggaacagttcatggagcttgagaacacatcacttcgcgtcctcttgaccggaggagacaagctgaagcgggcagtgaaaaagccgtacacactcgtcaacaactacgggccgacagaaaatacggtcgttgccacaagcgcagaaatccatccggaggaaggctcgctttccatcggacgggccattgccaatacgagagtatacattctcggcgagggcaatcaggtgcagccggaaggcgtagccggagagctttgcgtggcggggcgcggactggcacgaggctatctgaatcgagaagacgaaaccgcgaagcggtttgtcgctgatccgtttgtgccgggtgaacgcatgtaccgcaccggcgacttggtgaagtgggtgaacggcggcatcgaatacatcggccggatcgaccagcaggtcaaggtccgcggctaccggatcgagctctcagaaattgaagtccagctcgcccagctttctgaggtcgaggatcgggcggtgacacgtgtcaaagataaaggcggcaatacagcgatcgcggcgtatgtcacaccggaaacagctgacatagaagcactaaaatcaacactaaaggaaaccctgccggattacatgatcccggcattctgggtgacgctgaacgagcttccggttacggcaaacggcaaagtcgaccgcaaagccttgcctgagccggacatcgaagcgggaagcggagaatacaaagcgccgacgaccgacatggaagagctgcttgccggcatctggcaggacgtgcttggaatgtctgaagtcggtgtcaccgacaatttcttctcgcttggcggagattccatcaaaggaattcaaatggcgagccgcttgaatcagcacggctggaagctggaaatgaaagatctcttccagcatccgacgatcgaagagctcacccagtacgtagagcgtgccgaaggcaaacaggcagaccaaggcccggtggagggcgaagtcatcctgacgccgatccagcgctggttctttgaaaagaacttcacgaacaagcaccactggaaccaatcggtgatgcttcacgccaaaaagggctttgatcctgaacgggtggagaaaacattgcaggcgctgatcgagcatcatgacgcgctccgcatggtctaccgcgaggaaaacggggacatcgttcaggtgtataaaccgatcggtgagagcaaggtcagcttcgaaatcgtggatctgtacggctccgatgaagagatgctgagaagccagattaagcttctcgcgaacaagctgcaaagcagtctcgatctgcgaaacgggccgcttttaaaggcggcagaatatcgcacagaagctggggatcacctgctcattgctgtacaccatctcgtggtcgacggtgtgtcatggcggattttgcttgaagactttgcttcaggctacatgcaggctgagaaagaagagagccttgtcttcccgcaaaaaacaaactccttcaaggattgggcggaagaactggcggcattcagccaatcagcgcatcttttacagcaggctgaatactggtcgcaaattgccgctgaacaggtttctcctttacctaaggattgtgaaacagagcagcggatcgtcaaggatacatcatctgtcctatgtgaattaacggcagaagacactaagcatcttttaacagatgttcatcagccatatggaactgaaatcaacgatattcttctcagcgcgctcggtttgacaatgaaagaatggacaaagggggccaaaattggcattaaccttgagggacacggccgggaggacattatcccgaatgtgaatatctccagaacggtcggctggtttacggcacaataccctgttgtgctcgacatatctgacgcagatgcctcagctgtgatcaaaacagtcaaagaaaacctgcgccgcattccggacaaaggtgttggctacggcattcttcgttatttcacagaaacagcggaaacaaagggcttcacaccggagatcagcttcaactatttgggccaattcgacagtgaagtcaaaaccgatttctttgaaccgtccgctttcgatatggggcgccaagtaagcggagaatcagaggcgctgtacgcattaagcttcagcggcatgatcagaaacggccggtttgtgctttcctgctcctacaatgagaaggagtttgaaagagctacagtcgaggaggaaatggaacggtttaaagaaaacctcctgatgctaatccgccattgcacggaaaaagaagacaaggaattcacaccaagcgacttcagcgccgaagaccttgaaatggacgagatgggagatatctttgacatgcttgaggagaatttaaaa

SEQ ID NO: 46 - protein, 1520 aa, Artificial Sequence
  synthetic
LFEQPTVRQLAAYMEASAVSGGHQVLKPADKQDMYPLSSAQKRMYVLNQLDRQTISYNMPSVLLMEGELDIWPARLTPQLVNRHESLRTSFMEANGEPVQRIIEKAEVDLHVFEAKEDEADQKIKEFIRPFDLNDAPLIRAALLRIEAKKHLLLLDMHHIIADGVSRGIFVKELALLYKGEQLPEPTLHYKDFAVWQNEAEQKERMKEHEAYWMSVLSGELPELDLPLDYARPPVQSFKGDTIRFRTGSETAKAVEKLLAETGTTLHMVLHAVFHVFLSKISGQRDIVIGSVTAGRTNADVQDMPGMFVNTLALRMEAKEQQTFAELLELAKQTNLSALEHQEYPFEDLVNQLDLPRDMSRNPLFNVMVTTENPDKEELTLQNLSISPYEAHQGTSKFDLTLGGFTDENGIGLQLEYATDLFAKETAEKWSEYVLRLLKAVADNPNQPLSSLLLVTETEKQALLEAWKGKALPVPTDKTVHQLFEETVQRHKDRPAVTYNGQSWTYGELNAKANRLARILMDCGISPDDRVGVLTKPSLEMSAAVLGVLKAGAAFVPIDPDYPDQRIEYILQDSGAKLLLKQEGISVPDSYTGDVILLDGSRTILSLPLDENDEGNPETAVTAENLAYMIYTSGTTGQPKGVMVEDHALVNLCFWDHDAFSMTAEDRSAKYAGFGFDASIWEMFPTWTIGAELHVIDEAIRLDIVRLNDYFETNGVTITFLPTQLAEQFMELENTSLRVLLTGGDKLKRAVKKPYTLVNNYGPTENTVVATSAEIHPEEGSLSIGRAIANTRVYILGEGNQVQPEGVAGELCVAGRGLARGYLNREDETAKRFVADPFVPGERMYRTGDLVKWVNGGIEYIGRIDQQVKVRGYRIELSEIEVQLAQLSEVEDRAVTRVKDKGGNTAIAAYVTPETADIEALKSTLKETLPDYMIPAFWVTLNELPVTANGKVDRKALPEPDIEAGSGEYKAPTTDMEELLAGIWQDVLGMSEVGVTDNFFSLGGDSIKGIQMASRLNQHGWKLEMKDLFQHPTIEELTQYVERAEGKQADQGPVEGEVILTPIQRWFFEKNFTNKHHWNQSVMLHAKKGFDPERVEKTLQALIEHHDALRMVYREENGDIVQVYKPIGESKVSFEIVDLYGSDEEMLRSQIKLLANKLQSSLDLRNGPLLKAAEYRTEAGDHLLIAVHHLVVDGVSWRILLEDFASGYMQAEKEESLVFPQKTNSFKDWAEELAAFSQSAHLLQQAEYWSQIAAEQVSPLPKDCETEQRIVKDTSSVLCELTAEDTKHLLTDVHQPYGTEINDILLSALGLTMKEWTKGAKIGINLEGHGREDIIPNVNISRTVGWFTAQYPVVLDISDADASAVIKTVKENLRRIPDKGVGYGILRYFTETAETKGFTPEISFNYLGQFDSEVKTDFFEPSAFDMGRQVSGESEALYALSFSGMIRNGRFVLSCSYNEKEFERATVEEEMERFKENLLMLIRHCTEKEDKEFTPSDFSAEDLEMDEMGDIFDMLEENLK

SEQ ID NO: 47 - DNA, 3822 bp, Artificial Sequence
  synthetic
atgagtcaatttagcaaggatcaggttcaagatatgtattacctatcgccgatgcaggaagggatgctttttcatccgatcctgaatcccggccaaacgttttaccttgaacaaatcacgatgaaagtaaaaggcagcttgaatatcaaatgtcttgaagaaagcatgaatgtgatcatggaccggtacgatgtatttcgtaccgtgttcattcacgaaaaagtaaaaaggcctgtccaagtcgtattgaaaaaacggcagttccatatagaagaaatcgatctgacacacttaacgggcagcgagcaaacagccaaaatcaatgagtacaaagaacaggataagatcaggggttttgatttgacgcgggatattccgatgcgggcagccattttcaagaaagctgaagaaagctttgaatgggtgtggagctaccaccacattattttggacggatggtgcttcggcatcgtcgtacaggatctatttaaggtatacaatgctctgcgcgaacaaaagccgtacagcctgccgcccgtcaaaccgtataaagactacatcaagtggcttgaaaagcaggataaacaagcatcactgcgttactggcgcgaatatttagagggctttgaaggacaaacgacgtttgcggagcaaagaaagaaacaaaaggacggctatgagccgaaagagctgctcttttcactgtcggaggcggaaacaaaggcctttaccgagcttgcaaaatcgcagcataccactttgagtacggcgctgcaggcagtctggagcgtattgatcagccgctatcagcagtctggcgatttggccttcggtacagttgtttcagggcgtcccgcggaaatcaaaggcgttgaacatatggtcgggctgtttatcaacgttgtcccgagacgtgtgaagctgtctgagggtatcacatttaacggcttgctcaagcggctgcaggagcaatcgctgcagtccgagccgcatcaatatgtgccgctttatgacatccaaagccaggccgatcagccgaaactgattgaccacatcattgtttttgagaactatccgcttcaggatgcgaaaaatgaagaaagcagtgaaaacggctttgatatggtggatgttcatgtttttgagaagtcgaattatgatctcaacctgatggcttccccgggagatgagatgctgattaagcttgcctataatgagaatgtgtttgatgaggcgtttatcctgcgcttgaaatctcagcttcttacagcaattcagcagctcatccagaatcctgatcagcctgtcagcacgatcaacctcgttgacgacagggagagagaatttttgctaaccggcttaaacccgccggctcaagctcatgaaacaaagcctctgacgtattggttcaaggaagcagtgaacgccaatccggatgcaccggcgcttacgtattccggccagaccctgtcttatcgcgaattagatgaggaagcgaaccgcattgcacgccggctgcaaaaacacggtgcgggcaaaggctctgttgtagcgctgtacacgaagcgctcacttgaactggtgatcggcattctcggtgtattaaaggcgggagcagcctatctgccggttgatccgaagctgccagaggaccgaatctcgtatatgctggctgacagtgcggcagcctgtcttctgacgcatcaggagatgaaagaacaagcggctgagctgccgtatacaggcacaacgctcttcattgatgatcaaacacggtttgaagaacaggcaagcgatcctgcaaccgcgattgatcctaatgatccggcatatatcatgtacacgtccggcacaaccggaaagccaaagggcaatatcaccactcatgccaatattcaaggattggtcaagcatgtagactacatggcattttctgatcaggatacgttcttgtctgtttcgaattacgcctttgatgcatttacctttgatttctatgcttctatgctgaatgcggcacggctcattatcgcagatgaacatacgctgcttgatacagaacggctcacagatctgatcctgcaagagaatgtcaatgtcatgtttgcgacaaccgcactatttaatcttctcacagatgcgggagaggattggatgaaggggcttcgctgtatattattcggcggagagcgcgcgtcagtgcctcatgtcagaaaagcgctgcggatcatggggccgggcaagctgattaactgctacgggccgactgagggaacagtgtttgcgacagctcacgtcgtgcatgatctgccggattccatctcctcattgccgatcggaaagccgatcagcaatgccagtgtttatattctgaatgagcaaagccagctccagccattcggggcggtcggtgaactgtgcatcagcggaatgggcgtgtcaaaagggtatgtaaatcgtgctgacctcacgaaggaaaagtttatcgagaacccgttcaagccgggagaaacgctttaccgtacaggggatttagcgcgctggctgccggatggaacgattgaatacgccggccgtattgacgaccaggtcaaaatacgcggacaccggattgagcttgaagaaatcgaaaagcagctgcaggaatacccaggtgtgaaagatgcggtcgttgtggcggaccgccatgagtctggcgatgcatcaatcaatgcctaccttgtgaaccgaacgcagctttcagctgaagacgtgaaggcgcacctgaaaaaacagcttcctgcttacatggtgccgcaaacctttaccttcttggatgagcttcctttaacgacgaacgggaaagtcaataaacggctgctcccaaaacctgatcaggatcagctggcggaagaatggattggaccgcggaacgagatggaagaaacaatcgcacaaatatggtctgaggttctcggcagaaagcaaattggcattcatgacgatttctttgcgctcggagggcattccttgaaggccatgaccgccgtcccgcatcaacaagagctcgggattgatcttccagtgaagcttttgtttgaagcgccgacgatcgccggcatttcagcgtatttgaaaaacgggggctctgatggcttgcaggatgtaacgataatgaatcaggatcaggagcagatcattttcgcatttccgccggttctgggctatggccttatgtaccaaaatctgtccagccgcttgccgtcatacaagctatgcgcctttgattttattgaggaggaagaccggcttgaccgctatgcggatttgatccagaagctgcagccggaagggcctttaacattgtttggatattcagcgggatgcagcctggcgtttgaagctgcgaaaaagcttgaggaacaaggccgtattgttcagcggatcatcatggtggattcctataaaaaacaaggtgtcagtgatctggacggacgcacggttgaaagtgatgtcgaagcgttgatgaatgtcaatcgggacaatgaagcgctcaacagcgaagccgtcaaacacggcctcaagcaaaaaacacatgccttttactcatactacgtcaacctgatcagcacaggccaggtgaaagcagatattgatctgttgacttccggcgctgattttgacatgccggaatggcttgcatcatgggaagaagctacaacaggtgtttaccgtgtgaaaagaggcttcggaacacacgcagaaatgctgcagggcgaaacgctagataggaatgcggagattttgctcgaatttcttaatacacaaaccgtaacggtttca

SEQ ID NO: 48 - protein, 1274 aa, Artificial Sequence
  synthetic
MSQFSKDQVQDMYYLSPMQEGMLFHPILNPGQTFYLEQITMKVKGSLNIKCLEESMNVIMDRYDVFRTVFIHEKVKRPVQVVLKKRQFHIEEIDLTHLTGSEQTAKINEYKEQDKIRGFDLTRDIPMRAAIFKKAEESFEWVWSYHHIILDGWCFGIVVQDLFKVYNALREQKPYSLPPVKPYKDYIKWLEKQDKQASLRYWREYLEGFEGQTTFAEQRKKQKDGYEPKELLFSLSEAETKAFTELAKSQHTTLSTALQAVWSVLISRYQQSGDLAFGTVVSGRPAEIKGVEHMVGLFINVVPRRVKLSEGITFNGLLKRLQEQSLQSEPHQYVPLYDIQSQADQPKLIDHIIVFENYPLQDAKNEESSENGFDMVDVHVFEKSNYDLNLMASPGDEMLIKLAYNENVFDEAFILRLKSQLLTAIQQLIQNPDQPVSTINLVDDREREFLLTGLNPPAQAHETKPLTYWFKEAVNANPDAPALTYSGQTLSYRELDEEANRIARRLQKHGAGKGSVVALYTKRSLELVIGILGVLKAGAAYLPVDPKLPEDRISYMLADSAAACLLTHQEMKEQAAELPYTGTTLFIDDQTRFEEQASDPATAIDPNDPAYIMYTSGTTGKPKGNITTHANIQGLVKHVDYMAFSDQDTFLSVSNYAFDAFTFDFYASMLNAARLIIADEHTLLDTERLTDLILQENVNVMFATTALFNLLTDAGEDWMKGLRCILFGGERASVPHVRKALRIMGPGKLINCYGPTEGTVFATAHVVHDLPDSISSLPIGKPISNASVYILNEQSQLQPFGAVGELCISGMGVSKGYVNRADLTKEKFIENPFKPGETLYRTGDLARWLPDGTIEYAGRIDDQVKIRGHRIELEEIEKQLQEYPGVKDAVVVADRHESGDASINAYLVNRTQLSAEDVKAHLKKQLPAYMVPQTFTFLDELPLTTNGKVNKRLLPKPDQDQLAEEWIGPRNEMEETIAQIWSEVLGRKQIGIHDDFFALGGHSLKAMTAVPHQQELGIDLPVKLLFEAPTIAGISAYLKNGGSDGLQDVTIMNQDQEQIIFAFPPVLGYGLMYQNLSSRLPSYKLCAFDFIEEEDRLDRYADLIQKLQPEGPLTLFGYSAGCSLAFEAAKKLEEQGRIVQRIIMVDSYKKQGVSDLDGRTVESDVEALMNVNRDNEALNSEAVKHGLKQKTHAFYSYYVNLISTGQVKADIDLLTSGADFDMPEWLASWEEATTGVYRVKRGFGTHAEMLQGETLDRNAEILLEFLNTQTVTVS

SEQ ID NO: 49 - DNA, 2337 bp, Artificial Sequence
  synthetic
gtgagaatactattcctaacaacatttatgagcaaaggaaacaaagttgtacggtacttggaatcattacaccacgaagtcgtcatctgccaggaaaaagtgcacgcgcagtcggccaatttgcaagagatcgactggattgtcagctatgcatacgggtatattttggacaaagaaatcgtctcccggtttcgcgggcgcatcatcaaccttcatccttctcttttgccctggaacaagggacgagatcctgttttctggagcgtttgggacgagacacccaagggcgtgacgatccacctcatcgacgagcatgtagatacaggcgacattctcgtgcaggaagagattgcgtttgccgacgaagatactctgctcgattgttacaacaaagccaatcaggcgatcgaggaactgttcattcgcgagtgggaaaatatcgtgcatggacggatcgctccgtatcggcaaactgctggcggaacgctccacttcaaagcagaccgggatttttacaaaaacctgaacatgacgacagtacgagaattgttggcattaaagcggctttgtgcagagccaaaacggggcgaaaagccgatcgacaaaacgttccatcagctgttcgaacagcaggtggagatgacgccagaccacgtggctgtcgtcgatcggggccaatccttgacatacaagcaactaaacgaacgggccaatcagctggcgcaccatctcaggggcaaaggcgtcaagcctgacgatcaggtagcgatcatgctggacaagtctctggacatgatcgtgagcattctcgcggtaatgaaagcaggaggggcgtatgtgcccatcgacccggattatccgggagagcggattgcctacatgctggctgacagcagtgccgcgatcttgctgacaaacgctttgcatgaggagaaagcgaacggtgcctgcgacatcatcgacgtgcacgatcctgacagctacagcgagaacacgaacaatttgccgcacgtcaatcgcccggatgacctcgtgtacgtcatgtacacatcaggatcgacaggtttggcaaaaggcgtcatgatcgagcatcacaatctggtcaacttttgcgagtggtatcggccgtactttggcgtaacccctgcggacaaggcgttggtttattccagtttttcctttgacgggtctgcactggatatatttacgcatttgctcgctggcgctgcgctgcacatcgtgccttccgaacggaagtacgatttggacgctttaaacgattactgcaaccaggaagggatcacgatcagctatttgccgacgggtgccgctgaacagttcatgcaaatggacaaccagtcgtttcgcgtggtgattacgggcggggatgtgctgaaaaaaatcgagcggaacggaacgtacaagctctacaacgggtacgggccgacagagtgcaccatcatggtgacgatgttcgaggtggacaagccgtatgcgaatattccgattggcaagccgattgaccgcacccgcatcctgattttggacgaagcgctggcgttgcagccgatcggggtggcaggcgagctgtttattgtcggggaagggctggggcgcggatatttgaaccgtccggagctgacggcggaaaagttcatcgtccatccgcagacgggcgagcgaatgtaccgcacgggcgatcgggcacgctttttgcctgacggaaacatcgagtttctcggccgcctggacaatttggtcaaaattcgcggataccgcatcgagccaggagaaatcgagccatttttgatgaatcatccgctgattgaactgacaacggtattggcgaaggagcaagcggacgggcgcaaatacttggttggctattacgttgctcctgaagaaattccgcatggcgagctgcgggaatggctcgggaacgatctccccgattacatgatccccacgtactttgttcacatgaaggctttcccgttgaccgcgaatgggaaagtagacaggcgcgccttgccagacgtgcaggccgatgcggagttgctgggggaagattatgtcgcgccaactgatgagcttgaacagcaactggcacaggtgtggagccacgtgctggggattccgcaaatggggatcgacgaccattttctggagcgaggcggagactcgatcaaagtcatgcagctgattcaccagctcaaaaacatcgggctttcgctcagatacgaccagcttttcacgcatccgaccatccggcagttgaaacgtctgcttacggagcaaaagcaggtgagcctggagcctttgcgagagctggacgag

SEQ ID NO: 50 - protein, 779 aa, Artificial Sequence
  synthetic
MRILFLTTFMSKGNKVVRYLESLHHEVVICQEKVHAQSANLQEIDWIVSYAYGYILDKEIVSRFRGRIINLHPSLLPWNKGRDPVFWSVWDETPKGVTIHLIDEHVDTGDILVQEEIAFADEDTLLDCYNKANQAIEELFIREWENIVHGRIAPYRQTAGGTLHFKADRDFYKNLNMTTVRELLALKRLCAEPKRGEKPIDKTFHQLFEQQVEMTPDHVAVVDRGQSLTYKQLNERANQLAHHLRGKGVKPDDQVAIMLDKSLDMIVSILAVMKAGGAYVPIDPDYPGERIAYMLADSSAAILLTNALHEEKANGACDIIDVHDPDSYSENTNNLPHVNRPDDLVYVMYTSGSTGLAKGVMIEHHNLVNFCEWYRPYFGVTPADKALVYSSFSFDGSALDIFTHLLAGAALHIVPSERKYDLDALNDYCNQEGITISYLPTGAAEQFMQMDNQSFRVVITGGDVLKKIERNGTYKLYNGYGPTECTIMVTMFEVDKPYANIPIGKPIDRTRILILDEALALQPIGVAGELFIVGEGLGRGYLNRPELTAEKFIVHPQTGERMYRTGDRARFLPDGNIEFLGRLDNLVKIRGYRIEPGEIEPFLMNHPLIELTTVLAKEQADGRKYLVGYYVAPEEIPHGELREWLGNDLPDYMIPTYFVHMKAFPLTANGKVDRRALPDVQADAELLGEDYVAPTDELEQQLAQVWSHVLGIPQMGIDDHFLERGGDSIKVMQLIHQLKNIGLSLRYDQLFTHPTIRQLKRLLTEQKQVSLEPLRELDE

SEQ ID NO: 51 - DNA, 4572 bp, Artificial Sequence
  synthetic
cttttcacgcatccgaccatccggcagttgaaacgtctgcttacggagcaaaagcaggtgagcctggagcctttgcgagagctggacgagcaagcggagtacgagacttccgccgtcgagaagcgaatgtacatcatccagcagcaagatgtggagtcgattgcctacaacgtggtctatacgatcaacttccccctgactgtcgatacggagcaaattcgggtggccctggagcagctggtgctgcggcacgaaggtttgcgcagcacgtatcacatgcgcggcgacgagattgtaaaacggattgttcctcgggcagagctgtcctttgtgcgccagactggcgaggaggagtcggtacaaagcttgcttgcggagcagatcaagccgttcgatctggcgaaagcgccgttgctgcgggcgggagtcattgagacggcggacaaaaaggttctctggttcgattcccatcacattttgctggacggtctgtccaagtcgatcctggcgcgcgagctgcaagctttgctcggacagcaggtgttgtcgcctgtggaaaaaacgtacaagtcgtttgcacgctggcaaaatgaatggttcgcaagcgacgaatacgaacagcagatagcgtactggaaaacgcttttgcaaggagagcttcccgccgtccagcttccgacgaaaaaacgcccgccgcagctgacgtttgacggagcgatccagatgtatcgagtgaacccggaaattacgcgaaagctcaaggcgacagcggccaagcatgacttgactctgtacatgctgatgctcacgatcgtgtccatctggctgtccaaaatgaacagcgacagcaatcaagtcattctcggcaccgttacggacggcagacagcatccagatacgcgagaactgctggggatgttcgtcaatacgctgccgcttttgctctccattgatcatgaagaaagctttttacataacttgcaacaggtcaaggcaaagcttttgccggctttgcaaaaccagtacgtgccttttgacaaaattctcgaagctgcccgtgtcaagcgggaagggaaccgtcacccgttgttcgatgtgatgttcatgatgcaaggcgcaccggaaaccgagctggagagcaacatgcaccatataaatgccgggatcagcaagttcgatctgacactcgaagtcctggagcgggaaaacgggctgaacatcgtgtttgaatacaatacgcacctgtttgacgagggaatgatcctccgcatggtcgcgcagtttgagcacctgcttttgcaagccgtgcacgggctggaccaacaggtgaaaaggtttgaactggtaacggaagacgaaaaacgcgatttgtttttgcgggtgaacgatacagccaaggcgtatccgaacaagctgatcatgtcgatgctggaggattgggcggcggctacccctgacaaaacagcgctagtcttccgcgaacaacgcgtgacgtatcgcgagctgaacgagcgggtcaaccagttggcacacactttgcgcgaaaaaggggtgcaacctgacgatctcgtgatgctgatggcagagcggtcggtcgagatgatggtggcgattttcgctgtgttgaaagcgggcggagcgtacttgcccatcgacccgcacagtccggcggagcgaatcgcctacattttcgcagacagcggagccaagctggtgctggcacagtcgccgtttgtggaaaaggcaagcatggcggaagtggtccttgatctgaacagtgcgagcagctatgcggcggatacgagcaacccgccactggtcaaccagccaggcgatctggtgtatgtcatgtacacttccggctcaacgggaaaaccaaaaggcgtgatgatcgagcacggagcgctgctcaatgtgcttcacggaatgcaggacgagtacccgcttttgcaggacgatgccttcttgctcaagacaacctacatattcgatatttcagtcgcggaaattttcgggtgggttccgggtcgtggcaaactggtgattttggaaccggaggcggaaaagaacccgaaggctatttggcaggcggtagtcggagcgggaattacccacatcaacttcgtgccctccatgctgatcccgtttgtcgagtatttggaagggcgaacagaagcaaatcgcttgcggtacatcttggcttgcggcgaagcgatgccggatgaactcgtgccaaaagtgtacgaagtattgccagaggtgaagctggaaaacatctacggcccgacagaagcgacgatttacgcttcccgttactcgctcgcgaaaggctcgcaggaaagtcctgttccaatcggaaagccgctgcccaactatcgcatgtatatcatcaatcggcatggacaactgcaaccaatcggcgtaccaggagagctatgcatcgcaggagcaagtctggcgagagggtatttgaacaatccagcgctgacagaagaaaaattcactcctcatccgctggagaaaggcgagcggatttatcgcacgggtgatctcgcccgttatcgcgaggatggcaacatcgaatacctcggacggatggaccatcaggtgaaaattcgcggataccggatcgaactggacgaaatccgcagcaagctgattcaggaggaaacgattcaggacgcggtggtcgtagcccgaaacgatcaaaacggccaagcgtacttgtgcgcctacctgctgtccgaacaggagtggacagtcggtcaactgcgcgagttgcttcgccgtgaactgcctgaatacatgattccggcccatttcgttttgctgaaacagttcccgctcacagccaatggcaagctcgatcgcaaggctttgccagaaccggacggcagtgtgaaagcggaagcggaatatgcagcgccgcgcacggaactggaagcgactttggcgcacatttggggcgaagtgctcggaatcgaacggatcgggattcgcgacaactttttcgaactgggcggagattcgatcaaagggttgcaaatcgcctcccgactgcaacggatcaattggacgatggtgatcaaccacctgttcctgtacccgacgattgaacagattgccccattcgtcacgtccgagcaggtcgtcatcgaacagggactggtagaggggcttgtcaagctgacgccgatccagcgcgatttctttgaacggatcacagctgatcgacaccactggaaccaggcgaggatgctgttttgccgggatggcctggagcgtgagtgggtcgtggagacgctgaacgcgctcgttttgcagcacgatgccttgcgcatgcgttttcgcgagacagagcaggggattgtccagttccatcaggggaacgaaggcaagctgttcggcttccatgtgtttgattgcacggaggagctggacatagcgaaaaaagtggaggaacaagcaaacgtactgcaatccgggatgaatttgcaggaagggccgctcgtgcaggctgcgctgttcatgacgaggacaggcgaccatctgctcctggcgattcatcagctggttgtagacgaagcttcctggcggatcattctggaagacttccaaaccgcctacaagcaaaaagctgcgggcgagccaatcgccttgccaaacaaaacccactcgtatcagagctgggcggaagaactgcacaacgcagccaacagcaagaagctgacgagcgaactgggctattggagaaaaatcgcgtccagcccgacccgtccgctgccacaagatcaggagccgctttcccgaacggaacaaagcacggcgacagcagccattcgtttcgcgaaagcagagacagccaatctgctgcacgaggccaatcacgcctatcagacggaagcgcaggagcttttgttggccgccttgggcatggcattgcgggactggacaagagcagacgatgtcaccgtttttttggaaaaagacgggcgcgagtcggcagcaaaaggcttggatgtgtcgcggacggtgggctggttccattcgctgttcccggttgtcctctccgctgcgaggtcaggcgatccgggggagcagatcaagcaggtcaaagaaatgctgcgggcgattccgcatcaaggaagcgggtattccatcctcaagcagctcactgaccttcgacacaagcatccggacgattttacgctccagccaaagatcgtcgttcatgcatgggagcagctcgatgccggactggaaaccgattggctcacgctttcgcatcttccgcagggaagcgtgcgcggagcaaatgctgagcgcatgcagcaactggatgtattttccaaaatcagcaacggagagctgaccattcacatacagtaccatcgcgatgagtaccgcaaagcgacgatcgacaagctgctggagctttatcaagcgcatctgaatgcgctgcttgcccactgcctgcaaaagacagaaaccgagctgacaccgagcgattttgtggacaagaacctttcgcggagtgagctggacgacattatggacttgattagcgatttg

SEQ ID NO: 52 - protein, 1524 aa, Artificial Sequence
  synthetic
LFTHPTIRQLKRLLTEQKQVSLEPLRELDEQAEYETSAVEKRMYIIQQQDVESIAYNVVYTINFPLTVDTEQIRVALEQLVLRHEGLRSTYHMRGDEIVKRIVPRAELSFVRQTGEEESVQSLLAEQIKPFDLAKAPLLRAGVIETADKKVLWFDSHHILLDGLSKSILARELQALLGQQVLSPVEKTYKSFARWQNEWFASDEYEQQIAYWKTLLQGELPAVQLPTKKRPPQLTFDGAIQMYRVNPEITRKLKATAAKHDLTLYMLMLTIVSIWLSKMNSDSNQVILGTVTDGRQHPDTRELLGMFVNTLPLLLSIDHEESFLHNLQQVKAKLLPALQNQYVPFDKILEAARVKREGNRHPLFDVMFMMQGAPETELESNMHHINAGISKFDLTLEVLERENGLNIVFEYNTHLFDEGMILRMVAQFEHLLLQAVHGLDQQVKRFELVTEDEKRDLFLRVNDTAKAYPNKLIMSMLEDWAAATPDKTALVFREQRVTYRELNERVNQLAHTLREKGVQPDDLVMLMAERSVEMMVAIFAVLKAGGAYLPIDPHSPAERIAYIFADSGAKLVLAQSPFVEKASMAEVVLDLNSASSYAADTSNPPLVNQPGDLVYVMYTSGSTGKPKGVMIEHGALLNVLHGMQDEYPLLQDDAFLLKTTYIFDISVAEIFGWVPGRGKLVILEPEAEKNPKAIWQAVVGAGITHINFVPSMLIPFVEYLEGRTEANRLRYILACGEAMPDELVPKVYEVLPEVKLENIYGPTEATIYASRYSLAKGSQESPVPIGKPLPNYRMYIINRHGQLQPIGVPGELCIAGASLARGYLNNPALTEEKFTPHPLEKGERIYRTGDLARYREDGNIEYLGRMDHQVKIRGYRIELDEIRSKLIQEETIQDAVVVARNDQNGQAYLCAYLLSEQEWTVGQLRELLRRELPEYMIPAHFVLLKQFPLTANGKLDRKALPEPDGSVKAEAEYAAPRTELEATLAHIWGEVLGIERIGIRDNFFELGGDSIKGLQIASRLQRINWTMVINHLFLYPTIEQIAPFVTSEQVVIEQGLVEGLVKLTPIQRDFFERITADRHHWNQARMLFCRDGLEREWVVETLNALVLQHDALRMRFRETEQGIVQFHQGNEGKLFGFHVFDCTEELDIAKKVEEQANVLQSGMNLQEGPLVQAALFMTRTGDHLLLAIHQLVVDEASWRIILEDFQTAYKQKAAGEPIALPNKTHSYQSWAEELHNAANSKKLTSELGYWRKIASSPTRPLPQDQEPLSRTEQSTATAAIRFAKAETANLLHEANHAYQTEAQELLLAALGMALRDWTRADDVTVFLEKDGRESAAKGLDVSRTVGWFHSLFPVVLSAARSGDPGEQIKQVKEMLRAIPHQGSGYSILKQLTDLRHKHPDDFTLQPKIVVHAWEQLDAGLETDWLTLSHLPQGSVRGANAERMQQLDVFSKISNGELTIHIQYHRDEYRKATIDKLLELYQAHLNALLAHCLQKTETELTPSDFVDKNLSRSELDDIMDLISDL

SEQ ID NO: 53 - DNA, 3168 bp, Artificial Sequence
  synthetic
gtgtcaaggaaaaaggtcgacaatatatacccgttaactcctatgcaggagggaatgttgtttcattccctcctggacgaaggaagcgagtcctattttgaacaaatgcgctttacgatcaaagggctcatcgatccagctatcctggaacaaagcttgaacgcgctgattgaacgacacgatattctccgaacggtctttctcctggaaaaagtacaaaagccccggcaaatcgtgctcagggaaagaaagacaaaggttcaggtgctggatattacccacctttctgaaggggagcaagctgcctacctggaagactttgcgcagaaagaccgccaagcaagcttcgatttggccaaagacgtactgatccgtctcactcttgtccggacttcggctgacacgcatacccttttctggagtcaccatcatattttgctggacggttggtgcattccgattgtcctcaacgacttttttcaaatttatcaacagcgaaaaggcggcctgcccgtcgagcttggcccggtttacccttacagcacgtatatcagttggctgggagagcaggacgccgaagaggcaaaagcgagctgggctgagtatataagcggctatgaaccgaccagctttatacacaagcagggcggcaaaaacagctacagacaggcggaattggtgtttgcgattgagcaggggttgacggacagcttgaacaagctcgccaagcaattgcacgtgacgcttaacaatttgttccgcgcgatttgggggctgatgctgcaacgccagtgcaacacggaagacgtcgtgttcggctcggttgtctccggacgtccgagccacctgccgaacgtcgaacagatggtcggactgttcatcaacacggtgccgatccgcgtccaggcgggagcggagcaaacgttttccgagctggtgaagcaagtgcagcaggaagcgctctcgcttgccaaataccattatctttccttggccgacattcagggcaaccagcaactgattgaccatattctgctgttccagaactatccgatgggccagcaatttctgactcgtctgaaccagtacaacgaagagtttaccctcactcatctatctgcttttgaacaaaccaactacgacctgaacgtaatggttaccccaagtgatgtcatcaccatcaaatatatatacaatgctgctgtttttagcgaagaacagctccttcacatcagtcgacaactcaccaccatcatgacacaagtgacaaatgcgccagacatccttttgcaaaagctcgaagtggttgatccggcagagaaacagctgcaactgcattcctttaacgatacgtaccgccattatcctacagataagctgatccaccaaatttttgaagagcgcgccgagagggagccagagcgcatcgcgctggtcatgggagaacaagtccttacttatcgggagctgaacgaaaaggcaaatcaactggcgaagctgttgcgggcgagaggaatcggcccggaaagcatggtcagtttgcttaccgagcgttccgcagagatgatgattgcgattttggccatttttaaggcgggcggggcgtacttgccgattgatccgtcccatccgaaggaacgcattgaatatattttgcaagatagccgaagtgaattgttgctggtgaaccatcgctttcttggagcggtcgattttgcggatcggatcatcgatctggaagcagctgagatttaccagggagcagcggacaatctggagtgcgtctcccatgcgaaccatttggcttacgtcatctacacatcgggttcgacgggcaagccgaagggcgtcatgatcgagcatgcgagcttgttgaacatcatttttgccttgcaggaactgtatccgctgctggaaaacgatgcgtatttgctgaagacgacctacacttttgacgtttcggtcgcagaaatttttggctggattttggggagcggcagattggtcattctcgatcccggagcggagaaggagcctgcccacatctgggagacgatggtcaatcacggcgtgacacatgtcaattttgtgccgtcgatgttgattccgttcgtcgactatgtccgggatcaacagcaagaaagtccattgcgctatatatttgccgccggggaagcgatgccgtccgaactggtgggcaaagtgtacgaggcgctgccaggcgtcatcctggaaaatatttatggcccgaccgaatcgacgatttatgccacgaagtattccttggcaaaagattcgcaagacgtgctggtgccaatcggcaagccgctcgccaatattcagacgcatatcgtgaacaagcatggacaattgcagccagtcggcgtgcctggtgaattgtgcatcgccggagcgagcttggcgagaggctattggaacaacgaagcattgacgaacgaaaaatttgtgccccatccgtttgcagcgggacaacgcatgtaccgcacgggcgacttggcacgctaccgtcaggatggcaacatcgagtaccttggacggatcgaccatcaagtaaaaattcgcggctatcggattgaactggacgaaattcgcgctcagctgattcaggaagcttcgattcgcgacgctgtcgtgatcgctcgcacagaccataacgggcaagcgtatttgtgcgcgtatttcatcgcagacaagcagtggaccgtcaacgcgctgcgtgaagcgcttcgccaaacattgccggactacatggtgccgtcccattttattcagatggaagagttcccgctgacatcgagcggaaaaatcgatcgcaaagcgctgccgctcccggatggccgcgtgcatacaggcaacgtctatcttgcgccgcgcaatccggttgaggaactggtcgtccgcatctgggaggaagtgctcaatgtatcgcaggtcggggtgcacgacaacttttttgaattgggcgggcactcgcttttggcgacacaggtgctttcccgcacagccaagctgtttcatgtccggcttccgatgcgcgaaatttttacccatcagacagtagccgaattggctcggcggattcaagctttgcggcatggagcagaagcggacaagcacagcccgattcagccgtccgcgctccagcgt

SEQ ID NO: 54 - protein, 1056 aa, Artificial Sequence
  synthetic
MSRKKVDNIYPLTPMQEGMLFHSLLDEGSESYFEQMRFTIKGLIDPAILEQSLNALIERHDILRTVFLLEKVQKPRQIVLRERKTKVQVLDITHLSEGEQAAYLEDFAQKDRQASFDLAKDVLIRLTLVRTSADTHTLFWSHHHILLDGWCIPIVLNDFFQIYQQRKGGLPVELGPVYPYSTYISWLGEQDAEEAKASWAEYISGYEPTSFIHKQGGKNSYRQAELVFAIEQGLTDSLNKLAKQLHVTLNNLFRAIWGLMLQRQCNTEDVVFGSVVSGRPSHLPNVEQMVGLFINTVPIRVQAGAEQTFSELVKQVQQEALSLAKYHYLSLADIQGNQQLIDHILLFQNYPMGQQFLTRLNQYNEEFTLTHLSAFEQTNYDLNVMVTPSDVITIKYIYNAAVFSEEQLLHISRQLTTIMTQVTNAPDILLQKLEVVDPAEKQLQLHSFNDTYRHYPTDKLIHQIFEERAEREPERIALVMGEQVLTYRELNEKANQLAKLLRARGIGPESMVSLLTERSAEMMIAILAIFKAGGAYLPIDPSHPKERIEYILQDSRSELLLVNHRFLGAVDFADRIIDLEAAEIYQGAADNLECVSHANHLAYVIYTSGSTGKPKGVMIEHASLLNIIFALQELYPLLENDAYLLKTTYTFDVSVAEIFGWILGSGRLVILDPGAEKEPAHIWETMVNHGVTHVNFVPSMLIPFVDYVRDQQQESPLRYIFAAGEAMPSELVGKVYEALPGVILENIYGPTESTIYATKYSLAKDSQDVLVPIGKPLANIQTHIVNKHGQLQPVGVPGELCIAGASLARGYWNNEALTNEKFVPHPFAAGQRMYRTGDLARYRQDGNIEYLGRIDHQVKIRGYRIELDEIRAQLIQEASIRDAVVIARTDHNGQAYLCAYFIADKQWTVNALREALRQTLPDYMVPSHFIQMEEFPLTSSGKIDRKALPLPDGRVHTGNVYLAPRNPVEELVVRIWEEVLNVSQVGVHDNFFELGGHSLLATQVLSRTAKLFHVRLPMREIFTHQTVAELARRIQALRHGAEADKHSPIQPSALQR

SEQ ID NO: 55 - DNA, 4662 bp, Artificial Sequence
  synthetic
gtagccgaattggctcggcggattcaagctttgcggcatggagcagaagcggacaagcacagcccgattcagccgtccgcgctccagcgtgccgacgagttgccgctgtcttacgcccagcagcgtctctggttcctcgatcggctcatcccggacagcgccatgtacaacatccccgtcggcttccggctgcgcggaacggtcgatgagcttgtgctggaacgcgctttgaatgaaatcatccagcggcatgaatcgctccgcaccacgttcgtcgatgtggacgggcgagcgttgcaggtgattcatacggatgtgcatctgtcgcttggcgtcaccgatcttcgcgacaagccagccgcggcaaaagacgcggagtggaagcaaatggccgaggaagatgcagcaacgccgttccgcctcgatcaatggccgctgctgcgggcgatgctgattcgcttggaggagcaggagtctgtcctttggctgaacgtgcaccacatcatctccgacggctggtcgatggatgtactggtgaacgaactgagcgaagtgtacgaaacgttgctcaaaggagaagcgctgccgcttgccgccttgccgatccagtatcgggactatgccgtctggcagcgcgagaaatcccaagacgacgtatggaaagaacagcttcgttactggaaaaacaaactggatggcagcgagccgctgttgccgcttccgacagatcggccacgcgcggtcgttcaaagttatcgcggagatcatttgtctttttacgtgccgggtgaggtcgggcaaaagctgcgcgagctgggacggcaagagggcgctacgctgttcatgacgctccttgcggcattcaaaagctttttgtaccgctatacgcatgcgaacgacattttgattggcacccctgtcgccggacgcaatcggcaagagatcgaaaacttgatcggctttttcgtcaacatgctcgtcctgcgcactgatttgtccgatgatcctacgtttgtcgagctgttgcgtcgcgtgcgcgagacggcgttcgatgcgtttgccaacgaagatgtgccttttgaaaaactggtcgatgagctgcaaatcgagcgcagtctgagctactcgccgctgtttcaggtgctttttgctgtgcagggtatgtcgacaggcgtgcgtgaaggcgagacattggcgattgcgcccgatgaagtcacgctcaaccagacgaccaagttcgatctgactctgacgatgattgaagcggcggacaacggattgaaaggcgtgtttgaatacagcaccgatttgtttgaccgtacgacgatcgagcgcatggccgagcattttggcaatctgctgcaagccatcgccgccgatccggggcaaaaaattgtggagcttcccctgttgggcggtgcggaacaaagccggatgctcgtcgaatggaaccagacggatgtcgcctattccctcgacctgctagtgcacgaacgggtcgcgcgcatcgcacaggagctgccggaacagtttgccgtgatcggggagcaaggggcgctgacgtacgcacagctcgacgcgaaagccaaccagcttgcgcatgctttgctgaaaagagggattggttcggaggatttggtgggcatttgcgtggagcgttccagcgagatgcagatcggtcaactggcgattctcaaggcaggtgctgcctacgtcccgatggacccggcgtacccgcgcgaacggctcgctttcatgatcaaagatgcgggaatgtcgctcgttttgacccaggagcgcttgcttgacgcattgccgcaggaagcagcggcgcttctgtgcctggatcgggattggcaggagattgcggcggaaagtacggctgcgcctgcaatcaagacgaatgcggatcaacttgcctacgtcatttatacgtcaggctcgacggggacaccaaaaggtgtagagatcgagcacggatcgctcctgaatctggtcaactggcaccagcgcgcctacagcgtgtcggcagaagatcgtgcttcgcaaattgccggtacggcgtttgacgcttccgtatgggagacttggccgtatttgaccgcaggtgcgacgatttgccagccgcgggaagagattcgcctatcgccggaaaaactgcgggactggctggtcgagacaggcatcaccatcagctttttgccgactccgctggctgagaacttgcttccgctgccatggccgacgggagcggcgctgcgctacatgctgacgggcggtgatacgctgcaccaatacccgactgcggacgtgccgtttacgctcgtgaaccagtacgggccgacagaaaatacggtggttgcgacagcaggggcagtgcctgttttgggcgagcgcgagtctgcgccgacgattggtcgcccgatcgacaatgtgtctgtctacgtgttggatgaaaacagacagcctgtacctgtaggggtagtcggagagctgtacatcgggggaaaaagtctggcgcgcggctatcggaaccgtcctgacttgacggaagcgagctttgtgccgaatccgttctctccgattgaaggtgcccggatgtaccggactggtgacctggtgcgctatgcagcagatggcagcatcgagtttatcggacgtgccgacgatcaagtaagcattcgcgggttccgggttgagctgggcgagattgaatcggccttgtacgctcatcccgcggttgcagagtcggtggtgatcgtccgcgaagacgtgacccccggagtgaagcggcttgttgcgtacgccgtgctccatgaaggagaagagcgacagacgagcgagttgcgccagtccttgaaagaaatgttgccagattacatggtgccgtctgccatcgtgctgatggaagccctgccgctcacgccaaacggaaaagtagaccgtcgcgccttgcccttgccggatgtcgcgcagacagagtgggaaggcagctttgtcgaaccgcaatcggatgtggaacgcaagctggccgaaatttggcaagaggtgctgggcgtagagacgatcggggttcacgacaactttttcgaactgggcggcgactcgattttgaccattcagatcgtttcgcgggccaatcaggctggtttgcagttaacgccgaagcatttgtttgacgcgcaaacattggcagagctggcggcaagcgcagtggtgctggaaaaagcgccggaaatgcaggccgaacaaggaatcgtgacaggcgaattgcctttgacgccgattcagacgtggtttttcgagcaggatgtccgccacgttcatcactggaaccagtcggtcatgctcgcagtgcgggaagaactcgatatgacggcgctgacgcaagcttttgccgcgctgcctcgccagcatgatgccctgcgcctgcgctttcagcaggtcaacggaacatggcaggcagcgcatggtgagattgcggatgaagatgtgctgctggtcgccgatttgtcgtccgttcctgaggcggagagagaagcacggatgcggcacatcacagacgaactgcaagcaagcctggatatcgaaaaaggacctttgcaccgtgccgcctatttccaactcggagcggaacagcgtctgttcattgtgattcaccatctcgtggtcgatggcgtctcctggcgcattattttggaagacctgcaaaccgcttacgaacaggttaaagccgggcaaaagattgcatggccgcaaaagacgacttcgttcaaaagctgggcggaggagctgacaacgtacgcggagcaaagcgctgtcgatgagtattggactggcatggacagcgaacaggcatgcgggctgcctgttgatcatccacaaggcaagaacacggaaggtctggccgtgcaagtaaaggcaaagctgagcgcggacgagactcgggcgctgctgcaagaagtgccagccgcttatcgcacgcagatcaacgatgtgctgctcagtgccttgacgcgcacgattacggattggacgaacaagcgggcattgtatgtctcggtagagggacacggtcgcgagccgatcgtggatggcgtggacgtgtcgcgtacggtgggctggttcacgagcctgtatccggtcttgctggaaacggagccggatttggcctggggtgacttgctgaagtcgatcaaagaacaagtgcgggcgatcccggacaaagggattggctacggtattcaccgctatttgagccgggatgggcaaacggccgaaatgctgcgagccaagccgcagccggagatcagcttcaactacttgggacaattcggccaaggtcaaacgactgacgcggcgttgttccaaatcattccgaactggtcggcatccaatgtgagcgaggatgagacgcgtctttacaaactcgatgtcatgagcatggtggcgcaagaccagctggagatgagctggacattcagccgcgatctgtacgagccgggcacgattgaaaagctcgctcatgactatgtgcaagcgttgcgagcgattattgcccattgccgcacggagcaagcagggggctatacgccttccgacttcccgctcgcggaactggatcaaaacagtctcgacaagtttatcggtcacaatcgcctg

SEQ ID NO: 56 - protein, 1554 aa, Artificial Sequence
  synthetic
VAELARRIQALRHGAEADKHSPIQPSALQRADELPLSYAQQRLWFLDRLIPDSAMYNIPVGFRLRGTVDELVLERALNEIIQRHESLRTTFVDVDGRALQVIHTDVHLSLGVTDLRDKPAAAKDAEWKQMAEEDAATPFRLDQWPLLRAMLIRLEEQESVLWLNVHHIISDGWSMDVLVNELSEVYETLLKGEALPLAALPIQYRDYAVWQREKSQDDVWKEQLRYWKNKLDGSEPLLPLPTDRPRAVVQSYRGDHLSFYVPGEVGQKLRELGRQEGATLFMTLLAAFKSFLYRYTHANDILIGTPVAGRNRQEIENLIGFFVNMLVLRTDLSDDPTFVELLRRVRETAFDAFANEDVPFEKLVDELQIERSLSYSPLFQVLFAVQGMSTGVREGETLAIAPDEVTLNQTTKFDLTLTMIEAADNGLKGVFEYSTDLFDRTTIERMAEHFGNLLQAIAADPGQKIVELPLLGGAEQSRMLVEWNQTDVAYSLDLLVHERVARIAQELPEQFAVIGEQGALTYAQLDAKANQLAHALLKRGIGSEDLVGICVERSSEMQIGQLAILKAGAAYVPMDPAYPRERLAFMIKDAGMSLVLTQERLLDALPQEAAALLCLDRDWQEIAAESTAAPAIKTNADQLAYVIYTSGSTGTPKGVEIEHGSLLNLVNWHQRAYSVSAEDRASQIAGTAFDASVWETWPYLTAGATICQPREEIRLSPEKLRDWLVETGITISFLPTPLAENLLPLPWPTGAALRYMLTGGDTLHQYPTADVPFTLVNQYGPTENTVVATAGAVPVLGERESAPTIGRPIDNVSVYVLDENRQPVPVGVVGELYIGGKSLARGYRNRPDLTEASFVPNPFSPIEGARMYRTGDLVRYAADGSIEFIGRADDQVSIRGFRVELGEIESALYAHPAVAESVVIVREDVTPGVKRLVAYAVLHEGEERQTSELRQSLKEMLPDYMVPSAIVLMEALPLTPNGKVDRRALPLPDVAQTEWEGSFVEPQSDVERKLAEIWQEVLGVETIGVHDNFFELGGDSILTIQIVSRANQAGLQLTPKHLFDAQTLAELAASAVVLEKAPEMQAEQGIVTGELPLTPIQTWFFEQDVRHVHHWNQSVMLAVREELDMTALTQAFAALPRQHDALRLRFQQVNGTWQAAHGEIADEDVLLVADLSSVPEAEREARMRHITDELQASLDIEKGPLHRAAYFQLGAEQRLFIVIHHLVVDGVSWRIILEDLQTAYEQVKAGQKIAWPQKTTSFKSWAEELTTYAEQSAVDEYWTGMDSEQACGLPVDHPQGKNTEGLAVQVKAKLSADETRALLQEVPAAYRTQINDVLLSALTRTITDWTNKRALYVSVEGHGREPIVDGVDVSRTVGWFTSLYPVLLETEPDLAWGDLLKSIKEQVRAIPDKGIGYGIHRYLSRDGQTAEMLRAKPQPEISFNYLGQFGQGQTTDAALFQIIPNWSASNVSEDETRLYKLDVMSMVAQDQLEMSWTFSRDLYEPGTIEKLAHDYVQALRAIIAHCRTEQAGGYTPSDFPLAELDQNSLDKFIGHNRL

SEQ ID NO: 57 - DNA, 3237 bp, Artificial Sequence
  synthetic
gagcaagcagggggctatacgccttccgacttcccgctcgcggaactggatcaaaacagtctcgacaagtttatcggtcacaatcgcctgatcgagaacgtttatacgcttacgccgttgcaggaagggatgctgttccattccttgtatgagcaagcaggcggggattacgtggtgcagctcgctttgaaactggagcatgtgaatgtagaggcattttcggcagcctggcaaaaagtcgtcgagcgccacgcgattttgcgaacgtccttcctgtggagcggattggagaagccgcatcaggtcgtgcacgcgaaagtcaaaacgtttgtcgagcgactggactggcgccatctgacagcggctgagcaggaagcaggcttgcagacgtatttggaacaagatcgcaagcggggttttgatctcgcccgtccgccgctgatgcgctggacgttgattcgcctggatgcgagcacgttccagtttgtatggagcttccatcacatgttgctcgatggctggagcacgccgatcgtgttccaggactggcaggcgttttatgccgcagcctcgcatggcaaggaagcgagcttgcccgccattcctccgttttcagcctatattgcctggctgaaacgacaaaacctggaagaagcgcagcagtattggcgcgactatttgcagggctttggcgtgccgacgccgcttggcatggggaaatcgggtggcagcgcgggtcagccaaaagaatacgcagaccacaagctgcttttgtccgaacgggcgacagcgaacttgctcgcttttgcccgcaagcaccagttgacgctgaatacggttgtgcaaggggcttgggcgctgatcctggcgcgttatgcaggcgaagcggaagtcgtttttggcacgaccaatctgggacggccaaccgacttgcctgacgcagaagcgatggtggggctgtttatcaacacgttgcctgtccgtgtgcttttcccggaacagacgacggtcatcgactggctgcaaagcttgcagcaggcccaaagcgagatgcgccagtacgagtttacgccgctcgtggacatccagagctggagcgaggtgccgcgcggccagtcgttgtttgacagcattttcgtctttgagaactacttgtccggcacaagtgtggattccgaatccggcatgttgctcggggaagtcaaagcggtcgagcagacgagctatccgctgacgctcgtggtagcgcccggcgaagaactgatgctcaaactgatttatgaaacgggccgattcgagcagccagccatggacaaggtgctggcccagttgagcagtgtgctggaagcaatcatgcgtgagccgcacgaacagctcgcagacttgtccatcatcacggaagcggagcgccacaagctgttggtggaatggaatgcgaccgacatgccgtacgagcgcaacctggtgatgcaccagctgttcgaggcgcaagtggaggcaacgccggacgcgcaagctctggtcgtcggaaccgagcggttgacatatgcggaactgaacaaacgggcgaaccagctggcacattacctgcgggcgcagggcgtcgggccggaagtattggtcgctgtcctgatggagcggacgaccgagatgattgtcgccttgctgggaattatcaaggcgggcggtgcgtacgtgccgattgatcccgcttatccacaagacaggattggctacacgctggatgattcgcaggcggcgatcgtgttgacgcaagaacgcttgcttccgatgttgcctgagcatacagcacaagtgatttgcctggatcgcgactgggcgtgcatggcggttcagccggaagcaaatgtgccgaatctggctgcgccaaccaacctttcttacgtgatttacacatccggctcaacaggtctgccaaaaggggtggcgattcagcacagcagcgtcattgccttcattttctgggcgaaaaccgtcttctcggctgaagaaatgagcggcgtgctcgcgtccacttcgatttgcttcgacttgtctgtgtatgaaatattcgtgaccttgagttgcggcggcaaagtgattttggcggacaacgccttgcatttgccaagcctgccagcggcaaaagaggtgactttgatcaataccgtgccatctgcggccaaggagctggtgcggatgaacgcgataccgccgagcgtgcgggtcgtcaatctcgccggagagccgctgccgaacacgctggcgcaaagtttgtacgcgcttgggcatgtgcaaaaagttttcaacttgtatggcccatcggaagatacgacgtactccacttatgtccaggtgacaaaaggggcaaagacagagccgacgattggccgtcctttggccaacacgcaagcgtatgttctcgatgccaagctgcagcctgtgccgttgggcttgcctggggagctgtatttgggcggtgacggcttggcgcgcggttacttgaagcgtccgaaaatgacggcagaacgctttttgcccaatccgttccatcccgacccggatgcgcggatgtacagcacgggcgatctcgttcgttacttgcccgatggacagctggagtatttgggccgcatcgaccaccaggtcaaaattcgcggctaccggatcgaattgggcgagctggaggctgtcctgcgcagccatccacagatcaaggaagcagtggtcgtggccaaagaagacaagctgggcgaaaagcgtctcgttgcctacatcacgacaaaagacggggagtgcggcgatcgtgccgtcttgacgagctgggccaaggcaaaattgcccgagtttatggttccctccttctttgtctggctggacgcgatgccgctgacaccgaacggcaagatcgaccgcaagcaactgccggaaccggagtgggggcaagtcgcttctgccgctggctacgtagcgccgcgcaatcagacggaagtgttggtcgccagcatctgggcggatgtgctcggaatcgagcaagtaggggtgcacgacaactttttcgaactgggcggacattctctcctggcgacacgagtagcttcccgtctgcgcgaaacgtttgcgaaagaagtgccgatccgcgcgatttttgagcggccgactgttgcagagctgtccgagacacttggagcgattgggcagaacgaaacggaagcgcagatgctgcctgtctcacgg

SEQ ID NO: 58 - protein, 1079 aa, Artificial Sequence
  synthetic
EQAGGYTPSDFPLAELDQNSLDKFIGHNRLIENVYTLTPLQEGMLFHSLYEQAGGDYVVQLALKLEHVNVEAFSAAWQKVVERHAILRTSFLWSGLEKPHQVVHAKVKTFVERLDWRHLTAAEQEAGLQTYLEQDRKRGFDLARPPLMRWTLIRLDASTFQFVWSFHHMLLDGWSTPIVFQDWQAFYAAASHGKEASLPAIPPFSAYIAWLKRQNLEEAQQYWRDYLQGFGVPTPLGMGKSGGSAGQPKEYADHKLLLSERATANLLAFARKHQLTLNTVVQGAWALILARYAGEAEVVFGTTNLGRPTDLPDAEAMVGLFINTLPVRVLFPEQTTVIDWLQSLQQAQSEMRQYEFTPLVDIQSWSEVPRGQSLFDSIFVFENYLSGTSVDSESGMLLGEVKAVEQTSYPLTLVVAPGEELMLKLIYETGRFEQPAMDKVLAQLSSVLEAIMREPHEQLADLSIITEAERHKLLVEWNATDMPYERNLVMHQLFEAQVEATPDAQALVVGTERLTYAELNKRANQLAHYLRAQGVGPEVLVAVLMERTTEMIVALLGIIKAGGAYVPIDPAYPQDRIGYTLDDSQAAIVLTQERLLPMLPEHTAQVICLDRDWACMAVQPEANVPNLAAPTNLSYVIYTSGSTGLPKGVAIQHSSVIAFIFWAKTVFSAEEMSGVLASTSICFDLSVYEIFVTLSCGGKVILADNALHLPSLPAAKEVTLINTVPSAAKELVRMNAIPPSVRVVNLAGEPLPNTLAQSLYALGHVQKVFNLYGPSEDTTYSTYVQVTKGAKTEPTIGRPLANTQAYVLDAKLQPVPLGLPGELYLGGDGLARGYLKRPKMTAERFLPNPFHPDPDARMYSTGDLVRYLPDGQLEYLGRIDHQVKIRGYRIELGELEAVLRSHPQIKEAVVVAKEDKLGEKRLVAYITTKDGECGDRAVLTSWAKAKLPEFMVPSFFVWLDAMPLTPNGKIDRKQLPEPEWGQVASAAGYVAPRNQTEVLVASIWADVLGIEQVGVHDNFFELGGHSLLATRVASRLRETFAKEVPIRAIFERPTVAELSETLGAIGQNETEAQMLPVSR

SEQ ID NO: 59 - DNA, 4689 bp, Artificial Sequence
  synthetic
tttgagcggccgactgttgcagagctgtccgagacacttggagcgattgggcagaacgaaacggaagcgcagatgctgcctgtctcacgggaagctcatttgccgctgtcgttcgcgcaacagcgcctctggtttctggatcgcctgatgccggacagcacgttgtacaacattccgtcagccgtgcgcttgttgggagatttggatatcgccgcttgggaaaagagcctgcaagtgctgatccagcgccacgaaagcttgcggacgacttttggcgatgtggatggggaagcggtgcaagtgattcactcccggctggatggaaagctgaacgtgatcgacttgcgcgggatgccagcagacgagcgggaagcggaagctcatcgcttggccggattggaagcggcgacgccgtttgacctgagccaaggtcctttgctgcgcaccaccctgattcgtctggcggagcaagagtgcgtcttcttattcaacctgcaccatatcattttcgacggctggtcgatcggcattttcctcaaagaaatgcgggcgctgtacgaagcgtttgtgcgggaagaagcgcctgaattggccgagattacggtgcaatacgcagattacgccgtctggcagcggaagtggctggaaggggaagtgcttgccgagcagcttgcgtactggaaagaaaagctgagcggagccgaaccgctgctggctttgccgacagatcagccgcgtcctgccgtccagacgcatgatggcgcgatgcatacgatcaagctttcaggcgagctgtacgcaaagctgaacaagctcagccaggaagaaggcgcgaccttgttcatgaccttgctcgctgccttccaagtcttgctctaccgctatagcgggcaggaggacatcctcgtcggcagccctgtcgcgggacggaacagacaagagacggagccgctgatcggctttttcatcaacacattggtactgcggacggacttgtcaggagaaccgaccttccgcgagttgctggcacgagtgcgggagacggcgttcgaagcatacgcccatcaagatttgccgtttgaaaagctggtcgacgagttggagctggagcgcagtctcagctactcgccgctgttccaggtgatgtttgtcctgcaaaacttccagctgaacttggacgaaaaagctggtatccgtgtggctgattttgagatggacaagcatctggtcacttccaaatacgatctgacgctgacgatggcggaaaaacaaaacggactgttcgccacgtttgaatacaacacagcgctgttccatgaggcgacgatggagcgactgtcgcagcattttattcagctgctggaagctatcgttcatatgccggatcagggtattgcccgattgccgctgctgaaccagagcgagcgagcgcaattgctggtggagtggaacgacacgacgaccgcttatccgcgaaacaaacgggtggatcaattgttccgggaaacggcgctgctttatcctgagcgactggcggtcgttgcgggaaatcagacgcttacgtacgcggaattggagcgccgggccaaccagacagccaactacttgcaacaaaaaggagtgcggccgggtgcgctcgtcggcctctgcgtcaaacgttcgctggaaatgctgatcgggatgctcggcatactcaaggctggcggagcctatgtgccgctcgatcctgattatccagaggagcgtctggcctacatgatgggcgacgccggaatcacggtcttgctgacgcaggagcagctcatgcccggcttgccgtcaggggaacggactacgattgccctggatcgcgattggccgctgattgccaaggagagcgagcaggcgcctgacgtggacacgacagcggaaagtctcgcttacgtcatctacacatccggctcgaccggactgccaaaaggaacgcttgtcgttcatcgcggcatcgtccgcctcgtcaaggaaacggattatgtgacgatcacggagcaagacgtgttcctgcaagcgtccaccgtgtcgttcgatgcggcgactttcgagatatggggcagccttttgaacggggcgaagctcgtcctgctgccgccagaactgccgtcgctcgcagaaatcgggcaggcgatccagtcgcaccacgtgacgacactttggctgacagccgggctgttcacgctgatggtcgaccatcacaaggaatatttgtccggggttcgccaactgctcgtcggcggagatatcgtatccgttccgcatgtgaaaaaagcgctggaaatcgcagggctgacggtgatcaacggatacggcccgaccgaaaacacgacattcacctgctgcaatccggtcacggtcatgcccgaatcggcccacactttcccgatcggccgtccgatcaaaaacacgacggcatacgtgctcgatcgtcacatgcagcccgttccgattggcgtgactggcgagctgtacatcggcggcgacggtctggcggaaggctacttgaaccgcccagatttgacggcagagcggtttgtgcccaatccgtttgcaactgatcaggcggcacgtctttatcgcacaggcgacctggtgcgctacctgccggacggtctgatcgagttcatcgggcggcttgacaaccaggtaaaaattcgcgggttccgcatcgagttgagcgaagtggaagcggtcttggccaaacacccggcgattacggcttcggtggtgatcgtccacgaaaatgaggcgggcatgaagcagctcgtcgcctacgcagtcaaggacgccgagcaagagcttgggacagccgagctgcgccagcacttcaaagcacacgtgccggactacatggtgcctgccgcctttgtcatgctggatgctttgccgcttactccgaacggaaaagtggaccgcaaagcgctgccagcccctgttttggaacgcagccgggaagaggacgcatttgcagcggctacaagccatgtcgaacaaacgctggcagacatttggtgcgctgtactgcgcatggaccgcatcggcattcacgataacttttttgagcttggaggagactcgattctcagcattcaaatcgtcgcccgcgcgaacaaggccggcatccatttgactcccaagcaattgttcgatcagcaaaccattgccgagctggcaaaagttgcaggccaaagtacaaaggtggacgcagaacaagggaacgtgacgggcgaggtgccgcttttgccgatccagacatggtttttcgagcaaaagcaaccgacgccgcaccattggaaccaatccatgctgctgcaagtgaacgagccgttggaggaagagtgtttgagccaagccgttgcccaactgcttgctcatcacgacgcgctccgcttgcgctacaccttcgcagacggacagtggaagcagacgtatgccgacgtcgattcggaagtgccgctgcaagtggaggatttgtccatgagtccgccagcccagcaggcgcggaagatcgaaaagctcgcacagcaggcccaagcaagcctggatttgcagaacgggccgctgctgaaagtcgtctacttcgatctcgggtacgaccgaccaggccgtcttttgatggtcattcatcacctggcagtcgacggtgtctcgtggcgcatcctgatcgaagacttgcaaacagcgtacgggcaagcggaaaaaggcaacaagattcaactgccgccgaaaacgacctcttacaaggcatgggcagaaaaattgcataaatacgcgtcctctgagcggatgctggttgatcaggattactggctcaaggcggcagacgaactgtcgggtcacccactgcccgtgcatgactgggcggaaaacacagaagcaaacggccggatgtggacgatccacctggaagaagaagagacggacgcccttctgcaaaaagttccatcccgctaccgcgtgcaaatcaacgatattttgttgacggcgctggcgttggcatacggcaaatggacgggcgagtccgcgcttttggtcaatctcgaaggacacggtcgcgaagagttgttcgaggacgtcgacctttcccgcaccgtcggctggtttacgtcgatgtacccgctcctgattcaactggagccaaacacgtcttccgaggatgcgcttgcgcgagtcaaagaaaagctgcaacaaattccgcacaaaggtctcggctacggcctgctgcgctacatggcgcaagaccctgaactggtcgaaaagctaaaggcgattccgcaagcaccgctcagcttcaactatttgggacaattccaccaggcggcagatgcgaaagcgcttctggcatacgcagaaggcgagcggggcgcaaacagcggcccggacaacagacggactcacctgatcgatgtcgtgggggccgtcaccgaaggcaagctcggtctcagcttcctctacaacggaagactgtacagcgaatcgcatatcgaaacatttgcccgtcactacacggacgctttgcaatcattgatccaggcggagaaacaaagctacagagcggaagacttcgaggatgcagacttgagtcagagcgctttgaacaaggtgctcgcaaggttaaaaaatagaaaggggaatgaactccatgggggatctcac

SEQ ID NO: 60 - protein, 1563 aa, Artificial Sequence
  synthetic
FERPTVAELSETLGAIGQNETEAQMLPVSREAHLPLSFAQQRLWFLDRLMPDSTLYNIPSAVRLLGDLDIAAWEKSLQVLIQRHESLRTTFGDVDGEAVQVIHSRLDGKLNVIDLRGMPADEREAEAHRLAGLEAATPFDLSQGPLLRTTLIRLAEQECVFLFNLHHIIFDGWSIGIFLKEMRALYEAFVREEAPELAEITVQYADYAVWQRKWLEGEVLAEQLAYWKEKLSGAEPLLALPTDQPRPAVQTHDGAMHTIKLSGELYAKLNKLSQEEGATLFMTLLAAFQVLLYRYSGQEDILVGSPVAGRNRQETEPLIGFFINTLVLRTDLSGEPTFRELLARVRETAFEAYAHQDLPFEKLVDELELERSLSYSPLFQVMFVLQNFQLNLDEKAGIRVADFEMDKHLVTSKYDLTLTMAEKQNGLFATFEYNTALFHEATMERLSQHFIQLLEAIVHMPDQGIARLPLLNQSERAQLLVEWNDTTTAYPRNKRVDQLFRETALLYPERLAVVAGNQTLTYAELERRANQTANYLQQKGVRPGALVGLCVKRSLEMLIGMLGILKAGGAYVPLDPDYPEERLAYMMGDAGITVLLTQEQLMPGLPSGERTTIALDRDWPLIAKESEQAPDVDTTAESLAYVIYTSGSTGLPKGTLVVHRGIVRLVKETDYVTITEQDVFLQASTVSFDAATFEIWGSLLNGAKLVLLPPELPSLAEIGQAIQSHHVTTLWLTAGLFTLMVDHHKEYLSGVRQLLVGGDIVSVPHVKKALEIAGLTVINGYGPTENTTFTCCNPVTVMPESAHTFPIGRPIKNTTAYVLDRHMQPVPIGVTGELYIGGDGLAEGYLNRPDLTAERFVPNPFATDQAARLYRTGDLVRYLPDGLIEFIGRLDNQVKIRGFRIELSEVEAVLAKHPAITASVVIVHENEAGMKQLVAYAVKDAEQELGTAELRQHFKAHVPDYMVPAAFVMLDALPLTPNGKVDRKALPAPVLERSREEDAFAAATSHVEQTLADIWCAVLRMDRIGIHDNFFELGGDSILSIQIVARANKAGIHLTPKQLFDQQTIAELAKVAGQSTKVDAEQGNVTGEVPLLPIQTWFFEQKQPTPHHWNQSMLLQVNEPLEEECLSQAVAQLLAHHDALRLRYTFADGQWKQTYADVDSEVPLQVEDLSMSPPAQQARKIEKLAQQAQASLDLQNGPLLKVVYFDLGYDRPGRLLMVIHHLAVDGVSWRILIEDLQTAYGQAEKGNKIQLPPKTTSYKAWAEKLHKYASSERMLVDQDYWLKAADELSGHPLPVHDWAENTEANGRMWTIHLEEEETDALLQKVPSRYRVQINDILLTALALAYGKWTGESALLVNLEGHGREELFEDVDLSRTVGWFTSMYPLLIQLEPNTSSEDALARVKEKLQQIPHKGLGYGLLRYMAQDPELVEKLKAIPQAPLSFNYLGQFHQAADAKALLAYAEGERGANSGPDNRRTHLIDVVGAVTEGKLGLSFLYNGRLYSESHIETFARHYTDALQSLIQAEKQSYRAEDFEDADLSQSALNKVLARLKNRKGNELHGGSH

SEQ ID NO: 61 - DNA, 3222 bp, Artificial Sequence
  synthetic
atgaactccatgggggatctcactgatctatatacgctaaccccactgcaagaaggcatgctgttccactcgctgtactcggaaggatcggcttacatgattcaaactacggcgattcttacaggcgagcttgacatcgttccctttgaaaaagcgtggaagaaagtgattcagcgccactcgatcttgcgtaccggattcatctgggaagagacggagaagccgctgcaggcggtcttcgaaagcgttcctttttctatccggcaaaaagactggtcgtcatacggaagtgacgagcaggagagcatgctggcggcgtttttgcaaaatgaaaaagcggcgggcttcgacttgagcgaagccccgctcatgcgcgtgacgatcatcaagctgggcgaagccgtacaccgactgatctggagcttccaccacctgctgctggacggttggagcagcccgatcgtgtttcaggaagttctcgatttttatgaagcgtaccgccaaggcaaagacttgcgactgccgcaggcaaggccattcaaagactacgtctcctggctccgccgtcaggacaagacggcgtccgagcagttttggcgcgagtttttggggccgatggaaaatcctacgccgattccgttcgaaacgcacgccaagcgcaccgcgggccatgagggactggaaaagcagatcggggaagcgacccgcgctctgactgggcaagtgaccaaagcgcttgccaaactggcgcgaacgaataaagtcacggtcaacacgatcgtgcaaggggcatgggcgattttgctcagccggttgagcggcgaggaaaacgtcgtgtacggagtaaccggctccggccgtccgagcgacctgcctggcgtcgagcaaatggtcgggatgtttatcaacacgttgccgatgaaagcgaagatcgaaccggagcaatcattggctgactggttcaaagctttgcaggaacagcaatccaaagtgcgccagtatgaatacacgtcgttggtcgacattcaaggctggacggacgttccgcgcgggacaccgctgttcgagagcattttcgtattcgagaactatccgcttggcgaagaggacgagaaagaagtcggctttaccatctccgctgtgcagcacttccaggaggtggataatccgcttacggttgtcgggattccgggtgatccgttcagcatcaaaatgatgtatgcgacagaccgttttgaacaagcggcgatcgaacgaacactcgaccagctggcgcttattttggaagctatcgtcgacaatccggagcggtccctgtctgcgctgtcattgctccgtcccgaagaaagacagcatctgcttgtcgggctgaacgacacggcaaccaactatccgagcgacaaaacggtgcaccagttgtttgcggaaacggcagcccggcacccggagcgcattgccgcagttgcgggtgatcagcaattgacctatgccgagctggaagcgagagcgaatcagcttgccaactacttgcaaaagcaaggcgtggaagcaggcactctcgtcgggctgtgcgtcgaccgttcgctggatatgctcatcggtctgcttgcgattttgaaagcaggcggagcgtatgtgccgatcgatccggcttatcccgaagagcgccttgctttcatgctggcagatgcgaaaatttctattttgctgacgcaaaagcatctaggcaagcaatggaaaggacgcaagcgccgcacggtctatctcgaccgcgacgcgaaaaagtgggcagaggaaagcccgcttgcgcctgatgtggatacgacaaaagacagtctcgcctacgtcatttacacgtccggctcgacaggtacgccaaaaggggttctcgccgtgcatcgcggcgtcgttcgcctgggtcaaaaaacacgaactacgtcaccgattagcgaagcggacgtattcctgcaagcgtctacggtttcgtttgacgcggctacttttgaaatctggggcgcattgttgaacggagccaagctggtgctgatgccgccggatttgccatccctcgatgaactcggagaggcgattgtgcagcacaaagtaacgacgctttggctgacggcaggcttgttctcgatcatggtcgaccataacgcggactatttgcgcggggtgcgtcaactgctcgtcggcggcgatgtcgtctctgttccgcacgtgcgcaaagtgctggcgctgggcggagtgacggtaatcaacggctacggcccgacggagaatacgacttttacgtgctgctatcctgtcacggagttgtctgaagatattacttccttcccgattggccgaccgatcagcaatacgaccgtatacgtattggacaaacacaagcagcctgtcccgtatggagcagcaggcgagttatacatagggggagacggccttgctcttggttacttgaacaatgcggagctgaccgcagagcggttcgtggagaatccgttcgatccgcaaaaaggatcgcgtctgtaccggacgggcgatctggtgcgctacttgccgaacggcacgattgaatttatcgggcggatcgacaaccaggtgaaaatccgcggtttccgcatcgaattgggggaagtggaagcagcgcttgccttgcacccggaagtgagtgaaacggtcgtgatggcgcgggaaaacgaccgtggcgagaagcatttgacagcgtatgtgacggttgccaaagacgatgcgccagaagttgccgatttgcaggcatggctcaaaacgaaactgcctgaatacatggtgccttctgcttatgtgttcctagacgcgatgccgctgacagcaaacggcaagatcgaccgcaggcgcttgccggagccggagtgggggaaccgttcagagacaaaagcatacacagagccgcgcaatcaggcggaagagctgatcgcaagcatatggtcgcaggtgcttggagtcgaaaaagtggggattcacgataactttttcgagcttggcggtcactcccttttggcgacacgggtcatttcccggctgcgcgaagtgtttggagtcgagcagtctgtgcgctcgatttttgagcacccgacgattgacgcgtggagtgaacaaacggccgctcttcagctgggagggccgggcacggatgacagctcgactcagattcagcctgtgccaagagatggcgctttg

SEQ ID NO: 62 - protein, 1074 aa, Artificial Sequence
  synthetic
MNSMGDLTDLYTLTPLQEGMLFHSLYSEGSAYMIQTTAILTGELDIVPFEKAWKKVIQRHSILRTGFIWEETEKPLQAVFESVPFSIRQKDWSSYGSDEQESMLAAFLQNEKAAGFDLSEAPLMRVTIIKLGEAVHRLIWSFHHLLLDGWSSPIVFQEVLDFYEAYRQGKDLRLPQARPFKDYVSWLRRQDKTASEQFWREFLGPMENPTPIPFETHAKRTAGHEGLEKQIGEATRALTGQVTKALAKLARTNKVTVNTIVQGAWAILLSRLSGEENVVYGVTGSGRPSDLPGVEQMVGMFINTLPMKAKIEPEQSLADWFKALQEQQSKVRQYEYTSLVDIQGWTDVPRGTPLFESIFVFENYPLGEEDEKEVGFTISAVQHFQEVDNPLTVVGIPGDPFSIKMMYATDRFEQAAIERTLDQLALILEAIVDNPERSLSALSLLRPEERQHLLVGLNDTATNYPSDKTVHQLFAETAARHPERIAAVAGDQQLTYAELEARANQLANYLQKQGVEAGTLVGLCVDRSLDMLIGLLAILKAGGAYVPIDPAYPEERLAFMLADAKISILLTQKHLGKQWKGRKRRTVYLDRDAKKWAEESPLAPDVDTTKDSLAYVIYTSGSTGTPKGVLAVHRGVVRLGQKTRTTSPISEADVFLQASTVSFDAATFEIWGALLNGAKLVLMPPDLPSLDELGEAIVQHKVTTLWLTAGLFSIMVDHNADYLRGVRQLLVGGDVVSVPHVRKVLALGGVTVINGYGPTENTTFTCCYPVTELSEDITSFPIGRPISNTTVYVLDKHKQPVPYGAAGELYIGGDGLALGYLNNAELTAERFVENPFDPQKGSRLYRTGDLVRYLPNGTIEFIGRIDNQVKIRGFRIELGEVEAALALHPEVSETVVMARENDRGEKHLTAYVTVAKDDAPEVADLQAWLKTKLPEYMVPSAYVFLDAMPLTANGKIDRRRLPEPEWGNRSETKAYTEPRNQAEELIASIWSQVLGVEKVGIHDNFFELGGHSLLATRVISRLREVFGVEQSVRSIFEHPTIDAWSEQTAALQLGGPGTDDSSTQIQPVPRDGAL

SEQ ID NO: 63 - DNA, 4680 bp, Artificial Sequence
  synthetic
agtgaacaaacggccgctcttcagctgggagggccgggcacggatgacagctcgactcagattcagcctgtgccaagagatggcgctttgccgctgtcttttgcccagcaacgcttgtggttcttcgatcagttgatgccggacaacccgatgtacaacattccgtttgcgctgcgtttgcagggggaactcgacgtcgcagcatgggagaaaagcttgcaagcgattatcgcccgtcacgaaagcttgcgtacgacgttcactgacatagacggacaagccgtacaggtgattcatccgcagctggactggaaactggataccgtggacttgcgcgaccgttccagcgaggaaaagcagcaagcaagcgcgcgtctggctgctgacgatgccgcccggccgttcgatctgcgccaaggtccgttgatgcgcgcgacgatgatccggacagaggagcaagcgcacgtctttttgatcaacatgcatcacattgtttctgacggctggtcagtgggtgtcttcctgcgcgagttgtttgcccattacgaagcgtacagcaaaggcgaagtgccgcagctcgcgccaatgccgattcagtatgccgattttgccgcctggcagcgcgagtggctggagggcgaagtattggagcagcaagtcgcctactggaaagagaagctcggcggggcggaaccgctgctcgctttgccgacagaccgaccgcgtcctgccttgcaaagctacgaaggggcgacttacacgacgagcttttcgcacgatttgctcgctaaattgaaaaagctcagcaaggaagcccaacacgaccttgttcatgacattgctcgccgctttccaaacgtgctgtatcgctacagcggtcaggaagacatcgtcgtgggcagtccggtagctggacgcaatcgtcaggaaaccgagaaattgatcggcttcttcgtcaacacgcttgctttgcgcacgagcttgtcaggagatttgccctttaccgaattgctggcacgagtacgcgaaacagcgctggcagcttatgcgcatcaagatgtgccgtttgaaaagctggtcgatgaactgcaactggagcgcagcctcagctactcgcagctgttccaggtcatgttcgttctgcaaaacttcccgctggaggacgtcgagacagcaggtcttcacgttgcgccagtggataccgagagccatctgacgacttccaagttcgacctgactttgacgatgcgagagaaggaagacaccctcgtcgctgcatttgagtacagcacggacttgtttgaccgcacgacgattgagcgaatggctgagcatttgcaacatttgttggcgtcgatcgtcacgcaaccggaagcgtcgctcgatcagcttgccctcctcggcgagagcgaatggaataggctggtggtggagcaaaacgagacagccaccgactatccgcgtgacaaaacggcgcaccaactgtttgcggaaacggcagcccggtacccggagcgcatcgccgcagttgcgggtgaccagcaattgacctacgccgaactggatacaaaagcgaatcagctcgccaactacttgcaaaagcaaggcgtggaagcaggcactctcgtcgggctgtgcgtcgaccgttcgctggacatgctcgtcggtctgcttgcgattttgaaagcaggcggagcgtatgtgccgcttgatccggcttatcccgaagagcgcctcgccttcatgctggcagatgccaacgtatcgattttgctgacgcaaaaacatttaggcaagcaatggaaaggacgcaagcgccgcacggtctatctcgaccgcgatgcgaaaaagtggacagcggaaagtccgcttgcgcctgccgtggatgcgacaaaagacagtctcgcctacgtcatttacacgtccggttcgacaggcacgccaaaaggggttctcgtcgctcatcgcggcatcgtccgcctggtcaaaaacacaaactacgtcacgatcaccgaagaggatgtattcctgcaagcgtctacggtttcgtttgacgcggctacttttgaaatctggggcgcattgttgaacggagccaagctggtgctgatgccgccggatttgccatccctcgatgaactgggcgaagcgattgtgcagcacaaagtaacgacgctttggctgacggcaggtttgttctcgatcatggtcgaccataacgcagactatttgcgcggggtgcgccaactgctcgtcggcggcgatgtcgtctctgttccgcacgtgcgcaaagtgctggcgctggacggagtgacggtgatcaacggctacggcccgacggaaaacacgacttttacgtgctgctatcctgtcacagagctggcggaagagattacttccttcccgattggccgaccgatcagcaacacaaccgtgtacgtcttggacaaaaacagacagcccgttccgctgggcgtggctggcgaattgtatataggcggcgatgggcttgccagcggttacttgaacaacccggaactgaccgcagagcggttcgtcgacaatccgttcgacccgcaaaaagcttcgcgtctgtaccggacgggcgatctggtgcgttatttgccagacggcgcgatcgagtttatcgggcggatcgacaaccaggtgaaaatccgcggtttccgcatcgaattgggcgagatcgagacggcactgcttcgccatccggctgtgcaagaagcgtttctcatggtgcgcgaggatgcccctggcgacaaacggcttgccgcttacctcgtttttgcaggcggccaaaccgtcgagcctgtcgagatgcgttcgtatttgaaagataagctgcctgagtacatgatcccgtccgctttcgtgcagatggacagcttcccgttgactccgaacggaaaagtggatcgccgggcgctgccgactcccgagtatgcgcgcagcgaggccgccagcggttatgtcgctcctgcaacggagctggaagtgaagcttgcggatatatggaaaacggtgctgggtgtcgctgatgtgggcatccacgacaacttttttgaactgggcggcgattcgattctcagcatccagatcgtggcccgggccaaccagctcgggattcggctcacgccaaagcaactgttcgaaaaccagacgattgccgaattgctgcgcgtcgtggcggattccagccagttgccccatacgaaatgggaaaacgaacagggcatcgtgacgggaaatgtgccgcttaccccgattcagaagtggttttttgcagccgaccaaccgtcgttgcaccattggaatcaatctttgctgctgaccgttcagcaaccggttgacgtatccgtgctggagcgtgccatcgcaagcttgctgtcccaccacgatgcgttgcgcatgagcttttctttcgtggatggcgcgtggacgcagcaaatgaacggacttggcgaccacaccccgttccgttgcgtggatttgtccgacctttcgacacaagaacaagagcaggcagcccgcctggaggaaatcgccagcgaggtgcaagcgagcctgaatattgcggaaggcaatgtcgttcaagccgtgtatttcaatctgggtgaacagaaagcgggccgattgctgctcgtcgttcaccacctggtcgtcgacggcgtctcgtggcgcattttgctcgaagatttgcagcatgcctacgagcaattggcgaaccatgcagacgtgtcgttcccggcgaaaacgacttcgttcaaaatgtgggcggaaaaattggctgactatgccgactcggatgcgctagagcaggaaaaagcgtactggctgcaacaaagcagcggcggaagcccgcttccggtcgatcatccgtacgagccgaacgagaatacagaagcggctgcgaagcaagtgacgctttcgcttcgggcagacgagacgcgcgccttgctgcatgagacgcttaccgcttaccgcctgcaaatcaacgatgtattgctggccgctttggcgaaagcgatgcagcgttggacagggcaaaagacgttgcatgtccatctggaagggcacggacgcgaggaaatcatcgaaggcgcggatttgtcccggacggttggctggttcacgagcatgtatccggtacagcttgactttgaccagtcgaagccatgggggcatgtgctgaaagcagtcaaggagcagctgcgccacattccgcaaaaaggcatcggctacggcatcctgcaatacctcagcaatgatgacgagtggaaagagcagttgcaagcctatacgaagccggagatcagcttcaactacctcgggcagtttgaccaggtagtatcggctggcgcgaagtttgccatggccgaggagtcgcgaggggcgaatatcgccgcagacgcgattcgcgctcatttgattgatgtaaacagcgccatttccggggagcaattgcatatcacctggatgtacaacgcgaacatccataaccaagaaacaatcgaagcgcttgcccgtgattacatggagtctttgcgcgagattatggaacattgccgatcagaagaggcagggggctacaccccatccgatttcccgttagcgcgactggatcagcgcgctatcgacaactacgtgggccgggatcgctct

SEQ ID NO: 64 - protein, 1560 aa, Artificial Sequence
  synthetic
SEQTAALQLGGPGTDDSSTQIQPVPRDGALPLSFAQQRLWFFDQLMPDNPMYNIPFALRLQGELDVAAWEKSLQAIIARHESLRTTFTDIDGQAVQVIHPQLDWKLDTVDLRDRSSEEKQQASARLAADDAARPFDLRQGPLMRATMIRTEEQAHVFLINMHHIVSDGWSVGVFLRELFAHYEAYSKGEVPQLAPMPIQYADFAAWQREWLEGEVLEQQVAYWKEKLGGAEPLLALPTDRPRPALQSYEGATYTTSFSHDLLAKLKKLSKEAQHDLVHDIARRFPNVLYRYSGQEDIVVGSPVAGRNRQETEKLIGFFVNTLALRTSLSGDLPFTELLARVRETALAAYAHQDVPFEKLVDELQLERSLSYSQLFQVMFVLQNFPLEDVETAGLHVAPVDTESHLTTSKFDLTLTMREKEDTLVAAFEYSTDLFDRTTIERMAEHLQHLLASIVTQPEASLDQLALLGESEWNRLVVEQNETATDYPRDKTAHQLFAETAARYPERIAAVAGDQQLTYAELDTKANQLANYLQKQGVEAGTLVGLCVDRSLDMLVGLLAILKAGGAYVPLDPAYPEERLAFMLADANVSILLTQKHLGKQWKGRKRRTVYLDRDAKKWTAESPLAPAVDATKDSLAYVIYTSGSTGTPKGVLVAHRGIVRLVKNTNYVTITEEDVFLQASTVSFDAATFEIWGALLNGAKLVLMPPDLPSLDELGEAIVQHKVTTLWLTAGLFSIMVDHNADYLRGVRQLLVGGDVVSVPHVRKVLALDGVTVINGYGPTENTTFTCCYPVTELAEEITSFPIGRPISNTTVYVLDKNRQPVPLGVAGELYIGGDGLASGYLNNPELTAERFVDNPFDPQKASRLYRTGDLVRYLPDGAIEFIGRIDNQVKIRGFRIELGEIETALLRHPAVQEAFLMVREDAPGDKRLAAYLVFAGGQTVEPVEMRSYLKDKLPEYMIPSAFVQMDSFPLTPNGKVDRRALPTPEYARSEAASGYVAPATELEVKLADIWKTVLGVADVGIHDNFFELGGDSILSIQIVARANQLGIRLTPKQLFENQTIAELLRVVADSSQLPHTKWENEQGIVTGNVPLTPIQKWFFAADQPSLHHWNQSLLLTVQQPVDVSVLERAIASLLSHHDALRMSFSFVDGAWTQQMNGLGDHTPFRCVDLSDLSTQEQEQAARLEEIASEVQASLNIAEGNVVQAVYFNLGEQKAGRLLLVVHHLVVDGVSWRILLEDLQHAYEQLANHADVSFPAKTTSFKMWAEKLADYADSDALEQEKAYWLQQSSGGSPLPVDHPYEPNENTEAAAKQVTLSLRADETRALLHETLTAYRLQINDVLLAALAKAMQRWTGQKTLHVHLEGHGREEIIEGADLSRTVGWFTSMYPVQLDFDQSKPWGHVLKAVKEQLRHIPQKGIGYGILQYLSNDDEWKEQLQAYTKPEISFNYLGQFDQVVSAGAKFAMAEESRGANIAADAIRAHLIDVNSAISGEQLHITWMYNANIHNQETIEALARDYMESLREIMEHCRSEEAGGYTPSDFPLARLDQRAIDNYVGRDRS

SEQ ID NO: 65 - DNA, 3225 bp, Artificial Sequence
  synthetic
gaagaggcagggggctacaccccatccgatttcccgttagcgcgactggatcagcgcgctatcgacaactacgtgggccgggatcgctctatcgagaacgtctatccgctgacgccattgcaggaaggaatgcttttccattccttgtacgaacatgcgggcggagactacgtggttcagttttccatgacgatgcaccatgtcgaggtcgacgttttccagcaagcgtggcaaaaagtcgtggatcgccactccattttgcgtacatcgtttatttgggacggggtgtccacaccgcatcagatcgttcgcaagcacgtccaggttgtcgtggatgaacaagattggcggcatgtgcccgccgatcagcagaaagcggagtgggacgcctttttggaggaggatcgcaagcgcagcttcgcgatcacagaaccgccgctcatgcgctggacgttgcttcgcatcagcgatacggcctatcggtttatttggagcttccaccacgtcttgcttgacggctggagcgtgccgctggtcatgaaagactggttcgctgcctatatggctctggctgacggaaaagacattcagttcggcgctgtccatccgttttcccagtatgtcgcgtggattcagcgccaggacttgcaagcggctgaacgcttctggcgcaaccatctgaaagggatctacgcaccgacgcaagtgaacttcgggcagactgtgcaacctgtcggggagacgaaaagctacgatgagcgcagcatccgcttctccgcagagcggacgcgagagctgcaagcttttgcccgccagcatcaggtgacgctgaacacattggtgcaaagtgcctgggcgatgatcctcggcacgtacagcaaagaagcagatgtcgtattcggagcaaccggatcaggtcgtcctgccgatttgcctggcgtagaaaacatggtggggctgttcatcaatacgttaccgattcgcgtgacgctggaccccggcaaaaaagtccgggagtggctgcgcgaactgcaagagctgcaagtggagctgcgccagtacgaatacacgccgctggtcgacatccacggctggagtgaaatggcccgcaacgctccgctgttcgagagcattttcatcttcgagaactacccgattgacgagtcggtcaaagaagtcgatcacagcttccagatcgcggatgtggactcggtcgagcagacgaactacccgcttacggttgtttgcggccctggcgccgagtttctcgtgaaaatcaagttcgaccaaagccgatttgacggtggacgcatcgaacgcgtgctggagcaaatgacgcttttgctccaatcgatgaccgccaacccggatcagctgttggctgacgtgaacatgattagtcagagtgaacaaaagcaggttttgatcgagtggaacgagacgaaggtggactatccgaccgggctttgcgtgcagcaagcctttgaacagcaagtggaaaagacgccggatgccgtggcgctcatctacaaagacgtggagctgacgtacgccgatctgaaccagcgggcaaaccaactggcgcatcggctgctcgcgcaagaagtgaagccggacaccttggtcggcatctgcgtcgaacgctccccggaaatgatcatcggaattttcggggtgatgaaagcaggagctgcctacgtgccaatcgacccggctttgccgcaagagcgcatcgcctacatggtcgaagattcgcaggcgagcattttgctgacgcagcaatctttggctgagcttttgccaaaaacgcaggctcgcgtgatttgcctggacggtgattcgctggcaaatgagcctgttgccaatccggcaagcgaggtaacggagcaaaatctggcttatgtcatgtacacatctggttcaaccggattgccaaaaggggtcatggtggagcatcacagcgtggtgaatctggctcatgccttgatcgaggcgttccggattcagccatccagccgcgtcttgcagtttacgtcgttcagttttgacgtgtctgtgtccgagatcgtcatggcgttgctcgcaggtgcggccttggtgatcgaggatcgcgaagtgcttttgcctggcccggaattaatctcggttttgcaacaaaagcgcatcacgacagtctcgatggtgtcttcggttctggcggcactgcccgccgccgatctgcctgatttgcagacgctgatcgtgggcggagaagcaccgagccgcgagcttgtcgcccgctatgcggatcgtcgtcagtttttcaactgctacgggccgacagaggcaacggtttgctccacgatgatgctttgcaacgcggggatgaagagcgcgccgatcggtcgtccgctcgccaacgcgaccttgtacgtgctggatgcgaatcaaaagcctgtacctgtaggggtgcccggcgagctgtacatcggtggaaaaggactggcgcgcggctactggaaccgcccggagcttaccgcagagcgctttatcgcgcatccgttcggagcaaaaggagagcgtctgtatcgcacgggcgacctcgttcgctatttgccagacggcaaccttgagttcctcggacgcatcgatacccaagtgaaaattcgcgggtaccgtatcgagctgggcgaaatcgaaagtgcgctcagccagcacccggcgattcaggaagcggttgtcatcgcgtgggagcagcgtctggctgcgtatatggtggcagcgggcgaagcacaaccagcggcagaggagcttgcccgttatttgaaagagacattgcccgactacatgatcccggcaggctttgtctttatggacgcgattccgctcacggtgaacggaaaagtcgaccgcagagcattgcccgcaccggattgggggattttggcgacacgtcaagagtatgtcgcgccgcggacgccgacggaggaaatggtagcgaatatatgggcgcagctgctttccgtcgagaaaatcggcgtgcatgacgatttctttgagcggggcggacattcgctcctggcgacacaagcgatttcccgcttgcgacaagcatttggcgtagaattgccgctgcgcatgctgttcgatcacccgacgacggcggcgatcagtacacagattgcgtcccttttgcaaggggaaaccgctcttcgcagccagccaatcgtgccagtgccgcgcgac

SEQ ID NO: 66 - protein, 1075 aa, Artificial Sequence
  synthetic
EEAGGYTPSDFPLARLDQRAIDNYVGRDRSIENVYPLTPLQEGMLFHSLYEHAGGDYVVQFSMTMHHVEVDVFQQAWQKVVDRHSILRTSFIWDGVSTPHQIVRKHVQVVVDEQDWRHVPADQQKAEWDAFLEEDRKRSFAITEPPLMRWTLLRISDTAYRFIWSFHHVLLDGWSVPLVMKDWFAAYMALADGKDIQFGAVHPFSQYVAWIQRQDLQAAERFWRNHLKGIYAPTQVNFGQTVQPVGETKSYDERSIRFSAERTRELQAFARQHQVTLNTLVQSAWAMILGTYSKEADVVFGATGSGRPADLPGVENMVGLFINTLPIRVTLDPGKKVREWLRELQELQVELRQYEYTPLVDIHGWSEMARNAPLFESIFIFENYPIDESVKEVDHSFQIADVDSVEQTNYPLTVVCGPGAEFLVKIKFDQSRFDGGRIERVLEQMTLLLQSMTANPDQLLADVNMISQSEQKQVLIEWNETKVDYPTGLCVQQAFEQQVEKTPDAVALIYKDVELTYADLNQRANQLAHRLLAQEVKPDTLVGICVERSPEMIIGIFGVMKAGAAYVPIDPALPQERIAYMVEDSQASILLTQQSLAELLPKTQARVICLDGDSLANEPVANPASEVTEQNLAYVMYTSGSTGLPKGVMVEHHSVVNLAHALIEAFRIQPSSRVLQFTSFSFDVSVSEIVMALLAGAALVIEDREVLLPGPELISVLQQKRITTVSMVSSVLAALPAADLPDLQTLIVGGEAPSRELVARYADRRQFFNCYGPTEATVCSTMMLCNAGMKSAPIGRPLANATLYVLDANQKPVPVGVPGELYIGGKGLARGYWNRPELTAERFIAHPFGAKGERLYRTGDLVRYLPDGNLEFLGRIDTQVKIRGYRIELGEIESALSQHPAIQEAVVIAWEQRLAAYMVAAGEAQPAAEELARYLKETLPDYMIPAGFVFMDAIPLTVNGKVDRRALPAPDWGILATRQEYVAPRTPTEEMVANIWAQLLSVEKIGVHDDFFERGGHSLLATQAISRLRQAFGVELPLRMLFDHPTTAAISTQIASLLQGETALRSQPIVPVPRD

SEQ ID NO: 67 - DNA, 4689 bp, Artificial Sequence
  synthetic
acgacggcggcgatcagtacacagattgcgtcccttttgcaaggggaaaccgctcttcgcagccagccaatcgtgccagtgccgcgcgaccagcatgtaccgctttcgtttgcgcaacaacggttgtggttcctggacaggctgatcccgaacagcttcctgtacaacatcccgtccgctgcccgtctgcacggggaactggatgtcgaggcgtgggaacgcagtctcaagctgctgatccagcgtcacgagagcttgcggacgactttttcggatcgagacggggaagcggtgcaaatcattcacccggcaatcgagtggagcctgggccgagtggatttgcgcgaatgggccgaagctgagcgcgaagcgaaggcattgcagctcgcgatagaagatgccaagcgaccgtttgacctggagcgcggcccgttgctgcgggcgagcttgctcgtcatggctcagcaggagtacgtctttttgctcaacctgcaccatatcgttgcggatggctggtcgatgaacgtattcatggaagagcttgtgaccatatacgaagcattgtctgccggagaaacgccacagcttgccgaactgccgctgcaatacgctgactatgccgcatggcagcgcgattggctgcaaggcgacgtgctggagcagcagcttgcgtattggaaagcaaaagtcggtggcgcagaaccgctgcttgccctgccgacagaccgtccgcgtccggccgtgcaaagccacaagggagccatgcatacgatcacgcttccggcagagcggcttgcggctttgaaaacactcagccgggaagaaggctcgactttgttcatgaccttgctcgctgccttccagaccttgctttatcgctacagcggccaaagcgacatcgtcgtcggcagtccggtcgcgggacgcaacagacaggaaaccgagtcgctgatcggcttcttcattaatacactggcgatgcgcacggacctgtccggtgaaccgaccttccgcgatttgctcggaaaagtgcgcgagacggcgctggaagcgtatgcccatcaagacctgccgtttgaaaagctggtcgatgaactggagctggaacgaagcctcagctactcgccgctgttccaggtgatgttcgttttgcaaaacatcccgatggacgcccaagcgctgtcgcacattcgtcttgagccgttccacatcggtcaagagggagtcagcgcgaagtttgacatcaccttgaccacggtcgaattgcctgcagggctgatggcgacctttgaatacaataccgatctgtttgatccggcgacgattgagcgcatggcgggccattacgccaacctgcttgcagctgtgtcggtcaatccgctgcaaccgatcactgccattccgcttgtcagcgaccaggagcgtaagcaagtgcttttccaatggaacgatacgagcgtgccgtcagaacgcgatacgtgcgtgcatgagcaggttgcccgaatcgcgcagcagctgccgaatcagctggcagtcgtctcggacgaaggacagatcacctatgccgagctggatgccaaagcgaatcaagtagcgaattacttgcacaagcagggaattatctccgaaacgcttgtcggagtttgcctggatcgctccatcgacatgctcgtcgcccagctggggatactcaaggcgggcggtgcctatgtcccgatggacccggcgtatccgcaagagcggctcgcgttcatgatgcaagatgccgagatgccagtcgtattgacccaggagcatctgcttgcgcaattgccagaggcgagagcgacgttcctttgcctggatcgcgattggagtctcattgcagaagagagcgacgtggctccggtgatcgctacaaaccgcgacaatttggcctacgtcatttacacgtctggttcgaccggaacgccaaaaggggtagagatcgagcatgctgccttgttaaatctcgtctcttggcaccagcgcgcgtacgaggtgggcgcagaagaccgggcgacgcaaattgccgggacagcttttgacgcttctgtctgggaaatctggccgtatttgacaaagggagcgacgctgtacctcccgtccgaagaaatccgtctcgtgccggagcagctgcgagattggctcgtcgcatcaggcatcaccatcagctttttgccgacgccattggcggaacggttgctgaccttggagtggccgagcgatgccaagctgcgctacatgctgacaggaggagacaagctgcacgactacccgccggcaacgctgccgtttgttttggcgaaccaatacgggccgacggaaaacgccgtcgtcgccacggcaggcatcgttccggcagcagctggccaagtatccgcgccatcaatcggccgtccgatcgacaatgtgcaggtgtacgtgctcgatgaaaagctgcaacccgtgccgattggcgtagcgggagagctgtacatcgccggagacagcctggcgcgcggttatttgcatcgccctgacttgaccagagaacgcttcatcgcgaatccgtatgggcaaaaagcgggcgcgcgcatgtacaagaccggggaccttgtccgctacttgccggatggaaacatcgagttcatcgggcgcgctgacgaccaggtgagcattcgcggcttccgcgtcgaactcggtgaaatcgaaacggctctgtacagccacccggcggtcaaagaaacgattgtcctcgttcgcgaagacatgccggggatgaagcggcttgtcgcctatatcgtgcagcgagaagggcaggaaggacaagccgttcaagcaggcgacttccgcagctacttgaaggaactgttgcctgagtacatggtgccagcggcttttgtcttcatggctgacctgccgctgactccgaacggcaaagtggatcgccgcgcattgccagcgcctgatctgttcaatagcgaggcggacggcacttatgtagctccggcaaccgagctggagatcaagcttgcgcatatatggaaaaatgttcttggattagcggatgttgggatacacgataactttttcgaactgggtggcgactcgattctgagcatccagatcgtgtcccgggccaaccaggcggggattcgcctgacgccgaaacagcttttggcaaaccagacgattgcggaattggcaagcgtcgctacagtgacggacgaaagcgaagcaacaaaactgccgaatgaacagggcatcgtgacaggtgacgtgccgctcacgccgattcaaacgtggttcttcgcctccgaacagccgtctgtgcaccattggaatcaatccttgcttttgacggtgcagcagcctgtggatttggctgttttggagcgcaccatcgagtgcctgctcgctcatcatgacgcattgcgcatgcgctatagccggacagagcaaggctggacacagcggattgaaggacttcccgagacaattcctttccgcagcgtcgacctttccgccttcccgacgacggcggagcaagagatgcgactggaggaaatagccagcgaagtgcaagcgagcctcgatctgactgaggggcctgttgtccaagcggtttacttccagctaggggccgaacagccgggccgtctgttgatcgtcgctcaccatcttgtggtagacggtgtatcttggcgcattttgctcgaagacttgcaaaccgcttacgagcaattggcaaaaggacaagcggtgcagcttgcggcgaagacgacctcgttcaagacgtgggccgagcaattgcgattgtacgcgacgtccgaagcgcttcgtcaggaaaaagcattttggctggaacaaatggacgaggtaaaaccgctgccgattgaccgcatcttcgagccaagcgaaaacacggaagcgaccgttaaacaagtcatgctttccttgaacgcggaagagactcgcgccttgctgcaagatacgctctcgccatatcgtctgcaaatcaatgacgtgttgcttgccgctttgaccaaagcgctccatcgctggacaggcgagcagacagtcgcgattcatctggaagggcatgggcgcgaggagttgatcgagggcgcagacttgtcccggacggttggctggtttacgagcctgtacccggtacagctttcggtcgacccgacgaagccgtggggagacacgctgaaagcggtcaaggaacagttgcgcagcattccgaacaaaggcgtcggttacggcattttgcgttatttgagcgaggatgcggaactgcaaaaacgtctggcagaaaaggcgcaggcagaaatcagcttcaactacctcggacagtttgatcaggcagttgtacccgagtcgaaattcgggatggcgcaagaagcgagaggcgccaatgtggggcagcaggcgattcgccagcacctgctcgacgtaaacagcgtgattgcaggggagcagctccacgtcacgtggatgtacagcgaaaacattcacgaggaagccacgatccagcagcttgcccacaactatttggaagcgctgcgtgaaatcattgcgcacggccagtccgaagcggcaggcggctatacgccatctgacttcccgcttgcacggatggatcagcgcgcgctcgacaagtatttgggacaaaatcgctcg

SEQ ID NO: 68 - protein, 1563 aa, Artificial Sequence
  synthetic
TTAAISTQIASLLQGETALRSQPIVPVPRDQHVPLSFAQQRLWFLDRLIPNSFLYNIPSAARLHGELDVEAWERSLKLLIQRHESLRTTFSDRDGEAVQIIHPAIEWSLGRVDLREWAEAEREAKALQLAIEDAKRPFDLERGPLLRASLLVMAQQEYVFLLNLHHIVADGWSMNVFMEELVTIYEALSAGETPQLAELPLQYADYAAWQRDWLQGDVLEQQLAYWKAKVGGAEPLLALPTDRPRPAVQSHKGAMHTITLPAERLAALKTLSREEGSTLFMTLLAAFQTLLYRYSGQSDIVVGSPVAGRNRQETESLIGFFINTLAMRTDLSGEPTFRDLLGKVRETALEAYAHQDLPFEKLVDELELERSLSYSPLFQVMFVLQNIPMDAQALSHIRLEPFHIGQEGVSAKFDITLTTVELPAGLMATFEYNTDLFDPATIERMAGHYANLLAAVSVNPLQPITAIPLVSDQERKQVLFQWNDTSVPSERDTCVHEQVARIAQQLPNQLAVVSDEGQITYAELDAKANQVANYLHKQGIISETLVGVCLDRSIDMLVAQLGILKAGGAYVPMDPAYPQERLAFMMQDAEMPVVLTQEHLLAQLPEARATFLCLDRDWSLIAEESDVAPVIATNRDNLAYVIYTSGSTGTPKGVEIEHAALLNLVSWHQRAYEVGAEDRATQIAGTAFDASVWEIWPYLTKGATLYLPSEEIRLVPEQLRDWLVASGITISFLPTPLAERLLTLEWPSDAKLRYMLTGGDKLHDYPPATLPFVLANQYGPTENAVVATAGIVPAAAGQVSAPSIGRPIDNVQVYVLDEKLQPVPIGVAGELYIAGDSLARGYLHRPDLTRERFIANPYGQKAGARMYKTGDLVRYLPDGNIEFIGRADDQVSIRGFRVELGEIETALYSHPAVKETIVLVREDMPGMKRLVAYIVQREGQEGQAVQAGDFRSYLKELLPEYMVPAAFVFMADLPLTPNGKVDRRALPAPDLFNSEADGTYVAPATELEIKLAHIWKNVLGLADVGIHDNFFELGGDSILSIQIVSRANQAGIRLTPKQLLANQTIAELASVATVTDESEATKLPNEQGIVTGDVPLTPIQTWFFASEQPSVHHWNQSLLLTVQQPVDLAVLERTIECLLAHHDALRMRYSRTEQGWTQRIEGLPETIPFRSVDLSAFPTTAEQEMRLEEIASEVQASLDLTEGPVVQAVYFQLGAEQPGRLLIVAHHLVVDGVSWRILLEDLQTAYEQLAKGQAVQLAAKTTSFKTWAEQLRLYATSEALRQEKAFWLEQMDEVKPLPIDRIFEPSENTEATVKQVMLSLNAEETRALLQDTLSPYRLQINDVLLAALTKALHRWTGEQTVAIHLEGHGREELIEGADLSRTVGWFTSLYPVQLSVDPTKPWGDTLKAVKEQLRSIPNKGVGYGILRYLSEDAELQKRLAEKAQAEISFNYLGQFDQAVVPESKFGMAQEARGANVGQQAIRQHLLDVNSVIAGEQLHVTWMYSENIHEEATIQQLAHNYLEALREIIAHGQSEAAGGYTPSDFPLARMDQRALDKYLGQNRS

SEQ ID NO: 69 - DNA, 3252 bp, Artificial Sequence
  synthetic
gaagcggcaggcggctatacgccatctgacttcccgcttgcacggatggatcagcgcgcgctcgacaagtatttgggacaaaatcgctcgatcgaaaacgtctatccgctaagtccgttgcaaggcggcatgttgttccactctctgtacgagcaggagggaggagactacgtcgttcaactggcgatgacggtggaaggactggatgtcgaagcgtttgagcaggcgtggcaaaaagtcgtggatcgccattcgattttgcgcacctcgtttatatgggaaggcttgacggaaccgcatcaagtcgtccgcaagcaagtgaaggcgtgcgtggaaaaaatcgacctgcgccatctgacgcctgaccagcaaaaagcggagctgagcgaatacttggcggctgaccgccgacgcagcttcgagatcgctgtggcaccactcatgcgctggacgctgttccggttgagcgagagtgcgtatcgcttcacatggagcttccaccacgtcttgctcgatggctggagcatcccgattgtgctgaaagactggtttagcgcttatttgtctctggcagaaggaaaagaagtcgcgcacagctttgttcaaccgttcgctcattacgtagagtgggtacagcggcaagacttgcaagccgccgaacaattttggcgtgagcagcttgcaggcttttacgagccaactccactggcgatgggcaacagcactggcggccgggctgatttgccaaaagggtacgaggagcaagaaattcgtctggcgaaagacgcgaccgcccgcttgcaagcttttgtccgtacgcaccagttgacgctgaatacgttggtgcaaggggcgtgggcgctgatgcttggccgctacggcggaacggatgacgtcgtcttcggtgcgacagggtccgggcgtcccgccgatctgcctggcgtagagagcatggtgggacttttcatcaacactttgccgattcgcgttgctttggatgcgaaccaatccgttcgggaatggctgcgcggcatgcaggagcagcaagtggagcttcgccagtatgagtacacgccattggtcgacatccagggctggagtgaaatgacgcgcaacaccgccttgttcgaaagcattttcatttttgaaaattacccgatcggggagtcggtgaaagacgaacagcaccagctgcgcttgtctgacgtggagacgatcgagcagacgaactatccgcttacggtcgtctgcggcccgggcgaagagttgattgtaaaaatcaagtacgagcaaaaccgctttgcgcctgagcaaatcgagcgcgtgttgcagcagatgtctcagttgcttcaggacatgacagcaaagccggaacaacgtctccaggacgtgtcgatgatcagtgagcgcgagcgccagcaagttttggtcgactggaacgagacgagcgtggcctacccgcagcagctatgcgtccatcaggcgtttgaacagcaagtggaaaagacgccggatgccgttgctctcgtctacaaggacgtggaactgacctatgccgagttgaacgagcgggcaaaccagttggcccaccgattgcttgctgaaggggtaaaaccggatgagctggtaggcatttgcgtcgagcgttctccggaaatgatcgtcgctttcctcggcgtgatgaaagcaggggcagcttacgttccgctcgacccggcgcacccgcaagaacggattgcctacatgatcgaggattcgcaggcgagcgttttgttgacgcaggcttcacttacagacagactgccagcttcgtcccgtcaggtcatttgcctggacagcgacgaattggcgaacgagcctgtcacaaacgcggaaacgagcgtcggcgagcacaatctcgcttacgtgatctatacgtccggctcgaccggattgccaaaaggcgtaatgatcgagcatcgtagcgtgatcaatttggcctatgacttgatccgccatttccagatcgatgcgaccagccgcgtcctgcaattcatctcgttcagcttcgacgtgtcggtctcggagatcgtcatgagcctgctcgccggagcgacactcgtgatcgaggatcgcgagtcgcttttgccggggccagagctgatccgggtgctccaggagcaacgaattacgaccttcgcgatggtttcctctgtgctggctgccttgccagaagcagatttgccagacttgcggacgatcattgtcggcggggaagcgccaagccgggagcttgtcgcccgctacgcaacaggccgtcaattcatcaactgctacggaccgaccgaaacaaccgtcacggctacgctcaagcattgccaggacgacggcaaaaatccgccaatcggccgcccgatcgccaatacgacggtctacgtgctggacgctcatctgcaacctgtgccaatcggcgtgccaggtgagctgtacatcggcggaaaaggggtagcgagaggttactggaaccgtcccgagcttacagcagagcgctttatcgcggacccgttcggccaagcagacgagcgactgtaccggacgggcgacctggtgcgttacttggaaaacggcgagctggaatttctcggccggatcgacgaccaggtgaaaatccgcggctatcgcatcgagctgggggaaatcgaaaatgcgctcagacagcatccagcggtgcaaaatgtcgtcgtgatcgcacggcaggagggagcgggagacaaacgtctggcggcttatctggtcgccgcgaccgggcagcagccggatgaagcagagcttgtccgctacttgaagtcgaccttgccggaatacatggtgccagcaggctacgtctggctggaaaaaattccgctcacggtcaacggaaaagtggatcgccgcgcccttccagctcctgactacggacatgccgagacaggcaaagcgtacgtggcgccgcgcaagccgatcgaagaaatcgtggcgaacatttgggcacaagtgctttctgtagagcgcgtcggcgtttacgatgatttctttgaactgggcggacactcgcttttggctacgcaagccgtctcccgtttaaaagaagcatttggcgtcaatgtcccgctgcgcacgctgttcgaacatccagatgtggccggaatgagcgaaaagcttgccgggctgctagaggagcaatcaggcgtcaccagcattccgctcgttcctgtaccgcgggacaaacagttg

SEQ ID NO: 70 - protein, 1084 aa, Artificial Sequence
  synthetic
EAAGGYTPSDFPLARMDQRALDKYLGQNRSIENVYPLSPLQGGMLFHSLYEQEGGDYVVQLAMTVEGLDVEAFEQAWQKVVDRHSILRTSFIWEGLTEPHQVVRKQVKACVEKIDLRHLTPDQQKAELSEYLAADRRRSFEIAVAPLMRWTLFRLSESAYRFTWSFHHVLLDGWSIPIVLKDWFSAYLSLAEGKEVAHSFVQPFAHYVEWVQRQDLQAAEQFWREQLAGFYEPTPLAMGNSTGGRADLPKGYEEQEIRLAKDATARLQAFVRTHQLTLNTLVQGAWALMLGRYGGTDDVVFGATGSGRPADLPGVESMVGLFINTLPIRVALDANQSVREWLRGMQEQQVELRQYEYTPLVDIQGWSEMTRNTALFESIFIFENYPIGESVKDEQHQLRLSDVETIEQTNYPLTVVCGPGEELIVKIKYEQNRFAPEQIERVLQQMSQLLQDMTAKPEQRLQDVSMISERERQQVLVDWNETSVAYPQQLCVHQAFEQQVEKTPDAVALVYKDVELTYAELNERANQLAHRLLAEGVKPDELVGICVERSPEMIVAFLGVMKAGAAYVPLDPAHPQERIAYMIEDSQASVLLTQASLTDRLPASSRQVICLDSDELANEPVTNAETSVGEHNLAYVIYTSGSTGLPKGVMIEHRSVINLAYDLIRHFQIDATSRVLQFISFSFDVSVSEIVMSLLAGATLVIEDRESLLPGPELIRVLQEQRITTFAMVSSVLAALPEADLPDLRTIIVGGEAPSRELVARYATGRQFINCYGPTETTVTATLKHCQDDGKNPPIGRPIANTTVYVLDAHLQPVPIGVPGELYIGGKGVARGYWNRPELTAERFIADPFGQADERLYRTGDLVRYLENGELEFLGRIDDQVKIRGYRIELGEIENALRQHPAVQNVVVIARQEGAGDKRLAAYLVAATGQQPDEAELVRYLKSTLPEYMVPAGYVWLEKIPLTVNGKVDRRALPAPDYGHAETGKAYVAPRKPIEEIVANIWAQVLSVERVGVYDDFFELGGHSLLATQAVSRLKEAFGVNVPLRTLFEHPDVAGMSEKLAGLLEEQSGVTSIPLVPVPRDKQL

SEQ ID NO: 71 - DNA, 4650 bp, Artificial Sequence
  synthetic
ggaatgagcgaaaagcttgccgggctgctagaggagcaatcaggcgtcaccagcattccgctcgttcctgtaccgcgggacaaacagttgccgctgtctttcgcccagcaaaggctgtggttcctggatcgcctgatgccggacagcgccttgtacaacatcccgtctgccgtacggattcaagggcagctcaacatccgggcatgggagcgcagtctgcaaacgatcatcgagcggcacgaaagcttgcgcacgactttcaccgacatcggcggagaagcggtgcaagtcattcacgagatgatggaatggcgtctcgttgaaatcgacctgcgcgatttgccggacgaagagcgcgaagctgcggtacagcgtctggaaaaggcagaggccagccagccgttcaacttgcgtacagggccgttgctgcgagctacgctgattcagacgggcgaagaagatttcgtcttcctgctcaacatgcaccatatcgtctctgacggttggtcgatgagcattttcatgggagagcttgcgacgatttacgaagcgctctccaagggagatacgccgcagctcgccgaaatgccgctgcaatacgccgattttgccgcgtggcagcgcgattggctgcaaggcgaggtgctcgaacagcagctggcttactggagagaaaaactcggtgccgccgagccgatgctggctttgccgacagatcgtccgcgcccggctgtgcaaacgcatcacggagccttgtacacgacggcgttcccgctggcgttgacagaaaagctgcacgctttaagccgccaagaaggcgcgacgctgttcatgacgttgcttgcggcgttccagactttgctctatcgctacagcggtcaagacgacatcatcgtcggcagtccggtcgccggacgcaacaaacaggaaaccgagtcgatgatcggctttttcatcaacaccttggcgatgagaacggacatgtccggcgcacctactttccgcgaactgctggcgagagtacgcgatacggcgctggaagcctacacccatcaagacctgccctttgaaaagttaatagacgaactggagctggagcgcagcctgagctactcgccgcttttccaagtcatgttcgccctgcaaaacttccagatgctgacccgtgaatttgagggcatcgagatcgtaccgtttgaaagcaagaacgaagccgtcatgtccaagtacgacatcagcctgacgatggcggaaacgcaaaacggcttggtcgctacgtttgactacaacaccgatttgttcgaccacagcacgatcgtgcgcatggtcaatcatttccatcagctgctggagggcatcgtcgcccgaccggacagctcgattcaggcgttgccgctgcttgcgacagatgagcgcgagcagcttgtatccgcttggaacaacacggctgccgcttacacgtacgagcaaaccgtgcacgagctggttgccgctatggccgaaaaaatgccggagcaactggcggtcgtctccgccgaaggctcgctcacgtacgcacaactggatgcaaaagcgaaccagctggcgaactacctgcaacagcaagggattacaccagagacgctcgtcgggatttgcgtcgaacgctccagcgagatgatcgtcggacaactgggcattctcaaggcgggcggcgcgtttgtgccgatggacccagcctatccgcaagagcgtctggctttcatgatggcagacacaggcatgccgtttgtgctgacgcaagaacgcttgctggaaacattgcctgcgggcgatgccgcgttcatttgcctcgatgcggactgggaggtcattgccgaagagagcacgcaagcgccggaattggcagtgacaaccgaccagctcgcctacgtgatctacacgtccggctcaacgggaacgccaaaaggggtagagatcgagcaccgcgctctgttgaacctcatttattggcaccaacatgcctacaccatcacgccagatgatcgggcatcgcaaatcgcgggaacagcttttgacgccgctgtctgggaaatttggccgtacatgacggcaggagccacgctgtacttgccgcaggaagagattcgtctcatcccggaaaaactgcgcgactggctcgttgccgaaggaatcacgatcagcttcctgccgacgccattggcagagagcatgctgtctgttgactggccgtcccatgctgccttgcgttacgtgctgacaggcggcgacaagctgcatcattacccggcggagcatgtgccgtttacgctggtcaaccagtacggccctacggaaaatgcggtcgtcgccacagcaggcatcgtcgcggttcaagctggtcaggtcactccgccttcgatcggccgaccgattgacaacgtgcaagtgtacattttggacgaacagcgccagccagtgccgattggtgtgacaggcgagttgtacattgccggcagcagcttggctcgcggttactacaagcgtcctgatttgacgcaggaacgcttcgtcgacaatccgttcacagcgaatcgcggggcgaaaatgtaccggacgggggatctcgtgcgctatttgccagacggccagatcgaatttatcggccgctccgacgaccaggtgagcatccgcggtttccgcgtcgagttgggcgagattgagagtgtgctgtatcagcacccagcggtcaaagaggcgatcgttcttgcccgcgaagatatgccgggcgtgaaacgactggccgcctatgtcgtggtcgcagaagacgatgcggaacaagctgacgatttgcgcggctacctcaaggagaaactgccggaatacatggtgccagcggcctttgtcacgctgaaagctctgccgctcacgccaaacggcaaagtagaccgccgggccttgcctgtgccggagtacacagctgctgatggcgaatatgtagctccagagacgttcgtcgaaaaagttttggcgcaaatatggaaggaagtgctcggagtcgaggaagtcgggattcacgacaacttctttgaactcggcggcgattcgatcctgagcattcagattgtggccagagcagggcagtccggcatccgcctgtcgcccaagcttttattcgaaaatcagacgattgccgagctgtcgcatgctgtgggagattcggtccacatttgcgcggaacaaggtcttgtcacaggcgaagtgccactcctgccgattcagcactggttcttcgagcaaaaactggcggatcgcaaccattggaaccaatccgtcctgctcaccgttcagccgatcgatccggagattttgaaacaagccttttatcacttgctcggtcaccatgatgccttgcgtctccgtttctaccatcaaaatggagcgtggaagcaggcgggcgctgagtggaccgatatcattccgttttatgtggtggagctgggagatttgccagcgaaccagcaagtggagcagatcgagaagctgtccggggaagcgcaggcaagcttgcacctggcagatggcccgttgctccgcgccgtttacttcgacatgggcgcagggcaggaaggccgtttgctgatcgtcattcaccacctggcagtcgacggggtgtcatggcgaatcatcacggaagacttgaacaaggcgtgcaaccagcttttgcaaggcaagcaggtacaactgccgccgaagacaagctcctacaaatattgggcggaaaaactggtcgagtacgccgcgtccgacagtctcacggaagaggccgactactggctgagccgtctcgatacagaggtggctgctctgccaaaagattacgagcacggtcaaaaccgcgagctcgcagccagaaccgtttccgtcgccttgacgcaggaagagacgaaagtgctgttgcaagagctgccagccgtctaccaaacccagatcaacgacgtcttgctgactgccttggcagaagcggtcttcgtctggacgggcaatcagaccactttggtgcatctggaagggcacggacgcgaagacatttttgacgatgtcgatctgtcccggacagtcggctggttcacgagcatgtacacgattttgctggatacgcggggaacaagctcgcttacagaagcgctgcaaacgacgaaagaacagttgcgcagcattccgcacaaaggaatcggctacggcatcctccgttacttgaacaaggaaacggcggagaagttcaagtctttgcccaaagcgcagatcagcttcaactacctcggccagctggatcaggcggttcgtgacacggactcgttgttcggctttgccagcgaagcgagaggcgacaacttcaaccgcaactcggatcgtcaacacctgctcgatttcgggtgctcggtcgtcggtggtcaactggtggtgagcgtcgccttcagcaaagaaatttaccgcaaggaaacgatcgaagcgctggcagattactacatcactgccttgcgccaattgcttgcacacgcaaagacagacaaagccgccgcaccagcccaatcggctgcgagcaacttgtccgaatttggctgggatgacgaagagattgccgacttgcttgatctcatccaagacaag

SEQ ID NO: 72 - protein, 1550 aa, Artificial Sequence
  synthetic
GMSEKLAGLLEEQSGVTSIPLVPVPRDKQLPLSFAQQRLWFLDRLMPDSALYNIPSAVRIQGQLNIRAWERSLQTIIERHESLRTTFTDIGGEAVQVIHEMMEWRLVEIDLRDLPDEEREAAVQRLEKAEASQPFNLRTGPLLRATLIQTGEEDFVFLLNMHHIVSDGWSMSIFMGELATIYEALSKGDTPQLAEMPLQYADFAAWQRDWLQGEVLEQQLAYWREKLGAAEPMLALPTDRPRPAVQTHHGALYTTAFPLALTEKLHALSRQEGATLFMTLLAAFQTLLYRYSGQDDIIVGSPVAGRNKQETESMIGFFINTLAMRTDMSGAPTFRELLARVRDTALEAYTHQDLPFEKLIDELELERSLSYSPLFQVMFALQNFQMLTREFEGIEIVPFESKNEAVMSKYDISLTMAETQNGLVATFDYNTDLFDHSTIVRMVNHFHQLLEGIVARPDSSIQALPLLATDEREQLVSAWNNTAAAYTYEQTVHELVAAMAEKMPEQLAVVSAEGSLTYAQLDAKANQLANYLQQQGITPETLVGICVERSSEMIVGQLGILKAGGAFVPMDPAYPQERLAFMMADTGMPFVLTQERLLETLPAGDAAFICLDADWEVIAEESTQAPELAVTTDQLAYVIYTSGSTGTPKGVEIEHRALLNLIYWHQHAYTITPDDRASQIAGTAFDAAVWEIWPYMTAGATLYLPQEEIRLIPEKLRDWLVAEGITISFLPTPLAESMLSVDWPSHAALRYVLTGGDKLHHYPAEHVPFTLVNQYGPTENAVVATAGIVAVQAGQVTPPSIGRPIDNVQVYILDEQRQPVPIGVTGELYIAGSSLARGYYKRPDLTQERFVDNPFTANRGAKMYRTGDLVRYLPDGQIEFIGRSDDQVSIRGFRVELGEIESVLYQHPAVKEAIVLAREDMPGVKRLAAYVVVAEDDAEQADDLRGYLKEKLPEYMVPAAFVTLKALPLTPNGKVDRRALPVPEYTAADGEYVAPETFVEKVLAQIWKEVLGVEEVGIHDNFFELGGDSILSIQIVARAGQSGIRLSPKLLFENQTIAELSHAVGDSVHICAEQGLVTGEVPLLPIQHWFFEQKLADRNHWNQSVLLTVQPIDPEILKQAFYHLLGHHDALRLRFYHQNGAWKQAGAEWTDIIPFYVVELGDLPANQQVEQIEKLSGEAQASLHLADGPLLRAVYFDMGAGQEGRLLIVIHHLAVDGVSWRIITEDLNKACNQLLQGKQVQLPPKTSSYKYWAEKLVEYAASDSLTEEADYWLSRLDTEVAALPKDYEHGQNRELAARTVSVALTQEETKVLLQELPAVYQTQINDVLLTALAEAVFVWTGNQTTLVHLEGHGREDIFDDVDLSRTVGWFTSMYTILLDTRGTSSLTEALQTTKEQLRSIPHKGIGYGILRYLNKETAEKFKSLPKAQISFNYLGQLDQAVRDTDSLFGFASEARGDNFNRNSDRQHLLDFGCSVVGGQLVVSVAFSKEIYRKETIEALADYYITALRQLLAHAKTDKAAAPAQSAASNLSEFGWDDEEIADLLDLIQDK

SEQ ID NO: 73 - DNA, 3162 bp, Artificial Sequence
  synthetic
atgaataacattgaaacgtattatcccgttactcctttgcagcagggcctcatttttcacagtttgctggagccggagtccggagcctacatcgtacagatggggttgaagctgcaaggtcctctgaatattccgctgtttgaacaagcgtggcagtgcctcgttgacaggcacgcgatttttcgcaccagattcgttggcggaaaagtaaaagaatacgtccaggtcgtcttgaaggatctgaaaatttccctggtcgaacacgatcttattcatctttcttcctctgaacaagaagcgtttctgcaccattttgccaaagaagaccgcaaacgcggtttcgatatcgagcaagcgccgttgatgcggctgaatgtgtttcatttgaacagcgaaacggttcattttttgtggacattgcaccatgtattgatcgacggatggagtatgccgcttgttttcggggaagtgtttgcggcgtacgagatgctcagcaaagggcagccgctgagcctccctccggtcagagcttaccgcgattacattgtctggctgaaaaagcaggatttgcagcaggcggaagcgttttggcgcacgtatatgcaaggttttaccgaagccacgccgctttcgttcggacgagcctacaaaaatccgtacctcgatcaaaaacagtatcgggagctggatttgaccgtcagcgagcaaacttccaaagcgctgcaaacattggctcgccagcaccgcctgacggtcaatacgatcgtgcaaggcgcgtgggcgctgttgttgaatcgctacagcggccaggatgacatcgtatttggagccaccgtttcgggacgcccggctgacttgcccggagtcgagacgatgatcggcttgtttatcaatacattgccagtccgcgtgcaagtcaacgcggaggaaagcgtcatcaactggctcaaaacgctgcaacagcagcaagcggattttcgccaatatgaatacaccccgcttgtggaaatccaggggtggagcgacgtcccgcgcggccagtctttgttcgaaagcattctcgtttttgaaaacatgcctgtcggaaaatcgggaggcggggaaagcgccatctcgattgtggacgtctattccgaggagcagaccaactatccgtttacgctggttgcagcttcaggcaaaacgatcgacatcaaagtcaaattcgatgaaagccagtttgagcttgcggcgattgagcgggtagtcgaccagcttcattcgctcttgagctcgattgccaaaaacgcgaagcagcggattggcgatctgtccctgatcagcgagagcgagcggcaacaagttttggtcgagtggaaccagacggcagaggattacccgagcgggctttgcattcaccaagcttttgaacagcaagcagaaaagacgcccgatgcagtagcggtcgcctataaaaacagagagctgacctacgcgcagctgaacgagcgggcaaaccaactggcgcatcggcttatccgcaaaggggtcaaaccggatacgctcgtcggcatttgcctggaacgttccccggaaatgattatcggaatactcggggtcatgaaagcgggagccgcctacgtgccgattgacccggcccatccgcaggaacgcatcgcctatatggttgccgactcacaagcgagcgcattgctgacccagcagtcgctgctggagattttgccagtgacagccgcacacgtgatttgcctcgacagcgatcttttggcggatgaacctgttgacaacgcgtcttccgaggtgacggagcaaaaccttgcttacgtgatctacacgtccggctctaccggattgccaaaaggggtcatgatcgagcaccacagcgcgatcaatttggcttatgcgctgatcgacgcttttgacattcagccgaccagccgcgttttgcaattcacctcgttcagctttgacgtgtcagtttccgaagttgtaatggctctgctcgcgggtgcgacacttgtcatcgaggatcgggagtcgcttttgccaggccctgaactaattcaggttttgcaagagcaacgcattacaaccgtctccatggtgtcttccgttctggcggctttgcctgatgctgatctgcctgacctgcacaccttgattgtcggcggagaagcgccgagccgcgagcttgtggcacgctatgcgccaggccgtcagtttttcaattgctacgggccgacagaagcaaccgtttgctccacgatgatgctctgccaggccgggatgaacaacccgccgattggccgcccgattgccaacgcaaccgtgtacgtgttggatgccaacctcaatcccgttcccgtcggcgtgccaggggagctgtacatcggaggcaaaggcttggctcgcggctactggaaccgccccgagcttacagccgagagctttatcccgcatccttttggcacggcaggcgagcggctttaccggacaggcgatctcgttcgctatcggcaagacggcaatctcgaatttttgggtcgcatcgaccatcaagtgaaaattcgcggctaccgcatcgaattgggcgagattgaaaatgcaatccggcagcaccctgccgtacaggaggctgtcgtcatcgcccgcgaagaaaaagcgggagacaagcgtctggccgcctatctggtggcagcgggaaaagcacagccgcccgcagaggagatcgcgctttttctgaaagagacgctgcctgaatacatggttccggctggtgttgtttggctcgatgccattccgctcaccgtcaacggaaaagtagatcgtcgcgcgctgcccgtcccggattggggccagctttccacgaagcgggagtatgtggcgccgcgcacgcctacagaggaaatggtagccaacatctggtcgcaagtgctttcggtagagcgggtcggcagcttcgacgactttttcgagcttggcgggcattcgctgttggctacgcaaaccgtttcccgtctgaaagaagcgtttggcgtcgatttgccgctgcgtgtgctgtttgaatgctcgacagtgaacaagctgagcgaatggatcgcggctgctggcgaagacaaatctgggctgtcgcgcatcccgctcgttcccgtttcccgcgat

SEQ ID NO: 74 - protein, 1054 aa, Artificial Sequence
  synthetic
MNNIETYYPVTPLQQGLIFHSLLEPESGAYIVQMGLKLQGPLNIPLFEQAWQCLVDRHAIFRTRFVGGKVKEYVQVVLKDLKISLVEHDLIHLSSSEQEAFLHHFAKEDRKRGFDIEQAPLMRLNVFHLNSETVHFLWTLHHVLIDGWSMPLVFGEVFAAYEMLSKGQPLSLPPVRAYRDYIVWLKKQDLQQAEAFWRTYMQGFTEATPLSFGRAYKNPYLDQKQYRELDLTVSEQTSKALQTLARQHRLTVNTIVQGAWALLLNRYSGQDDIVFGATVSGRPADLPGVETMIGLFINTLPVRVQVNAEESVINWLKTLQQQQADFRQYEYTPLVEIQGWSDVPRGQSLFESILVFENMPVGKSGGGESAISIVDVYSEEQTNYPFTLVAASGKTIDIKVKFDESQFELAAIERVVDQLHSLLSSIAKNAKQRIGDLSLISESERQQVLVEWNQTAEDYPSGLCIHQAFEQQAEKTPDAVAVAYKNRELTYAQLNERANQLAHRLIRKGVKPDTLVGICLERSPEMIIGILGVMKAGAAYVPIDPAHPQERIAYMVADSQASALLTQQSLLEILPVTAAHVICLDSDLLADEPVDNASSEVTEQNLAYVIYTSGSTGLPKGVMIEHHSAINLAYALIDAFDIQPTSRVLQFTSFSFDVSVSEVVMALLAGATLVIEDRESLLPGPELIQVLQEQRITTVSMVSSVLAALPDADLPDLHTLIVGGEAPSRELVARYAPGRQFFNCYGPTEATVCSTMMLCQAGMNNPPIGRPIANATVYVLDANLNPVPVGVPGELYIGGKGLARGYWNRPELTAESFIPHPFGTAGERLYRTGDLVRYRQDGNLEFLGRIDHQVKIRGYRIELGEIENAIRQHPAVQEAVVIAREEKAGDKRLAAYLVAAGKAQPPAEEIALFLKETLPEYMVPAGVVWLDAIPLTVNGKVDRRALPVPDWGQLSTKREYVAPRTPTEEMVANIWSQVLSVERVGSFDDFFELGGHSLLATQTVSRLKEAFGVDLPLRVLFECSTVNKLSEWIAAAGEDKSGLSRIPLVPVSRD

SEQ ID NO: 75 - DNA, 4659 bp, Artificial Sequence
  synthetic
acagtgaacaagctgagcgaatggatcgcggctgctggcgaagacaaatctgggctgtcgcgcatcccgctcgttcccgtttcccgcgatcggcatttgccgctttcttttgcccaacagcgcttgtggttctttgatcggttgatgccaaacagtgcgctctacaacatcccgacagccgtacgcttgcaaggggagctggatatggacgctctggagcaaagcttgcagacgatcatccagcgtcacgaaagcttgcgcacgacgttcacggaccataacggagaagccgtgtcggtgattcaccccgagatcgactggaagctggaacggatcgatctgcgcgaacggtcggaggaaatgcgcaatgaagcaggactgcgcttggcgaaagaggaggcgaacagaccgtttgacctcgtcacaggcccgctcatgcgcgcgacgatcatccagacagacgagcgtgatttcatcttcctgttaaatgtgcatcacatcatcgccgatggctggtcggcaggcattttgatccgtgaattgttccattgctatcaggcgtttgccaaggcggaagctccgcaactggctgaattgccgattcaatacgccgattatgcttactggcagcgcgaatggctcacaagcgatgttttggacgagcaactgtcgtactggcgggcgaagcttgggggagcagaaccgctgcttgccttgccgacagatcgtcctcgtcccgctgtgcagtcttatgcaggcagcagcatctcgttgctgttcgatgacgagctgagagcgaatctccttgccttgagcaaaagggaaggaacgacgctgttcatgacgctgctcgcagccttccaagtgttcctgtaccgctatacaggccaggacgacattctcgtcggcacgccggaagcgggccgcagtcgccaggagacagaaggattgatcggctttttcatcaacacactcgtcatgcgaaccgacttgtcaggcgagccgagcttcaaagaagtgcttgcccgcgtgcgggagacggctttgggcgcgtatgcccatcaagacttgccttttgaaaagctggtcgacgagttgaacgtggagcgcagcctgagctactcgccgctgttccaggtgatgtttgtcctgcaaaacattccggttcaggcagacgcgctggatggaatccgcattttgccgctggaaggcagccagcaggtggagacgaccaagttcgatctcaccttgacgatggcagaagcggcaaacggtttggcggcgacgttcgagtacaacacggcgctgtttgagcgaaatacggtggagcggatgatcgggcactttagctcgttgctgaaagccgttgctgccaacgcgaaccaagcgatcactgctttgccgctgatgagcgaagtggaggagcagcaactggttctggaatggaacgatacggctgtggcctactccacggagcagcttgtccatgagctggtggcacaagtggcccgcgatatgccagaccagcctgctgtcgtcacgcgtgatcaactcctgacgtacggacaactggaagccaaagcgaaccagttggcgcactatttgcaaaagcaaggcgtgggtcgaggcagtctggtcggcatttgcgtcgagcgttctgtcgagatggtcatcgggcagctggcgatcatgaaagcgggcgctgcctacatcccgatggacccggcgtatccgaaagagcgtctcgccttcatgatgcacgatgcgagcatggcgattgtgcttacgcaagcaaaactcaggcaaaaactgcccgcagacacgagtcggctgatttgcctggacgccgattgggagacgattgcgcaagagcctacagcagctctggtcaacacaactgccgcaagcgacctggcctacgtcatctacacatccggttcgacaggcacgccaaaaggagtcgagatcgagcacgccgctctcttgaatctgattttctggcatcagcgggcgtatgacgtcacggcgacagaccgggcatcgcaaattgccgggacagcttttgacgcatccgtctgggaaatttggccttatgtaacaaaaggagccaccttgtatttgccggaggaagaaatccggcttgtcccggaaaaactgcgtgactggctcgtcgcttcgaacattaccgtaagctttttgccgacgccgctgacggagagcatgctcgctttggagtggccgggcgatactgcgcttcgctacatgctgacaggcggagataagctgcatcactacccgtcagagaagattccgttcactctcgtaaaccaatacggccctactgaaaatacggtcgtggcgacggcgggcatcgttccgaaagaagcagggcaaacggccgctcccacgattggccgtccgatcgacaacgttcaggtgtacattctcgatgcccataggcagcctgttcctgtaggcgtttccggtgaactgtacatcggcggaagttcccttgcgcgcggttacctgaatcgtcccgatttgacgcaagagcgctttgtcgctcatccattcacggagaaagcaggggcacgtctctatcgcacaggggatttggtgcgctccttgccggacggcagtatcgagttcatcggtcgtgccgacgatcagacgagcattcgcggattccgtgtggagctgggagaagtggagacggcaattgttgccttgccagcggtaaaagaagcggtcgtcaccgtttgcaccgacaagcaaggaacgaagcgcctggctgcctacctcgttttggaggaaggggcggcgcttgcgacaggcgacattcgcaaagcgctcaaggaaacattgccggattacatggttccggcatttttcacccagctggcgtacttgccgctcacgccaaacggcaaggtagaccgtaaaaatttgcccgcgccggatttccaacgtccggagctggaaggagagttcgtctcgccttcgacagaaaaagaacggcgcttggcggccatctggaaagacgtgctcgggatcgaacaaatcgggatacacgacaatttcttcgagctgggcggcgactcgattctcagcatccagatcgtgtcccgcgcgaatcaggcagggttgtcgcttgcgccgaagcagctgttcgaataccagacgatcgcggaactggcggagatcgtggaggaaaaagcagcggtgcaagcggaacaaggagccgtcacaggcgagctgccgcttttgccgatccagaagtggttcttccggcttcctttggcaaaccgcgatcattggaaccagtccgtgctgctttccattcaggctggcatcgatcctgcggcgctgaaacaagcggtcggacagctcatgttccagcacgatgctttccgcatgcgctatacacaaagcgaaagcggctggctgcaagcgatggatgcgccaagcgagacgattccgtttcgcgtggaagatttgtcccagctggcaccagaggaacaatccagtgccatcgaagcgattgccaacgagacacagacgcaactgagtttgcgtgccgggcaagtcgtgcaaaccatctacttccatctcggaaaagaggtgccgggccgcctcctgatcgtcgcccatcacctggttgtagacggcgtgtcgtggcggattatcctcgaagacttgcagcatgcctaccagcaaatcgccgcaggtcaagaggtgaagctgccagcgaaaactacgtcctacaaagagtgggcgcaagaactggagcgctacgcgcattccgaagcgttcaagcatgaaaaaagctattggctgtccaagtcctccgtccattcgactgaactgcccgcagacatgccagatagtgcggaaaatacggaagcgacagtcaagtccgttcatttttccttgaccgtcgaagagacgaaagcacttttgcagcaggtgccgcaagcgtaccgtacccagatcaacgacgtcttgctggccgctttggccaaggcgctcggtcagtggacgggcaaacgttcggtgttcgtcaacgtcgaaggacacggacgcgaagagctggcggaacatctggatttgtcccgcaccgtcggctggttcaccagcatgtatccggtacacctgcaatgggacgagacattttcggtgagacgggcgcttttgacaacgaaagaagaactgcgcgccatcccgaacaaaggacttggctacggcgtgctccgctacctccatgcggaacaggagatcgtcgatgccatatcccgcatacaagccgacgtattgttcaactacatgggcaaaattgatcagatcgtcggcagcgattccttgtttggctcggcacctgagtccagcggagcgaatctttgcccgagcgcgcaaaggcatcacctgctcgacgtaaacagcgtagtagcaggggaacagctccacgtgacttggcggtacagcgagaagcttcagcgagagagtacgattgcggcagtagcggagagcttcatggctgccttgcgcgagattgtcgcccattgcacactgccggaagcaggagggtactccccgtccgacttcccgttggctgtactggagcaaaagcagatcgacaaacacatcggtttcgaccggcaa

SEQ ID NO: 76 - protein, 1553 aa, Artificial Sequence
  synthetic
TVNKLSEWIAAAGEDKSGLSRIPLVPVSRDRHLPLSFAQQRLWFFDRLMPNSALYNIPTAVRLQGELDMDALEQSLQTIIQRHESLRTTFTDHNGEAVSVIHPEIDWKLERIDLRERSEEMRNEAGLRLAKEEANRPFDLVTGPLMRATIIQTDERDFIFLLNVHHIIADGWSAGILIRELFHCYQAFAKAEAPQLAELPIQYADYAYWQREWLTSDVLDEQLSYWRAKLGGAEPLLALPTDRPRPAVQSYAGSSISLLFDDELRANLLALSKREGTTLFMTLLAAFQVFLYRYTGQDDILVGTPEAGRSRQETEGLIGFFINTLVMRTDLSGEPSFKEVLARVRETALGAYAHQDLPFEKLVDELNVERSLSYSPLFQVMFVLQNIPVQADALDGIRILPLEGSQQVETTKFDLTLTMAEAANGLAATFEYNTALFERNTVERMIGHFSSLLKAVAANANQAITALPLMSEVEEQQLVLEWNDTAVAYSTEQLVHELVAQVARDMPDQPAVVTRDQLLTYGQLEAKANQLAHYLQKQGVGRGSLVGICVERSVEMVIGQLAIMKAGAAYIPMDPAYPKERLAFMMHDASMAIVLTQAKLRQKLPADTSRLICLDADWETIAQEPTAALVNTTAASDLAYVIYTSGSTGTPKGVEIEHAALLNLIFWHQRAYDVTATDRASQIAGTAFDASVWEIWPYVTKGATLYLPEEEIRLVPEKLRDWLVASNITVSFLPTPLTESMLALEWPGDTALRYMLTGGDKLHHYPSEKIPFTLVNQYGPTENTVVATAGIVPKEAGQTAAPTIGRPIDNVQVYILDAHRQPVPVGVSGELYIGGSSLARGYLNRPDLTQERFVAHPFTEKAGARLYRTGDLVRSLPDGSIEFIGRADDQTSIRGFRVELGEVETAIVALPAVKEAVVTVCTDKQGTKRLAAYLVLEEGAALATGDIRKALKETLPDYMVPAFFTQLAYLPLTPNGKVDRKNLPAPDFQRPELEGEFVSPSTEKERRLAAIWKDVLGIEQIGIHDNFFELGGDSILSIQIVSRANQAGLSLAPKQLFEYQTIAELAEIVEEKAAVQAEQGAVTGELPLLPIQKWFFRLPLANRDHWNQSVLLSIQAGIDPAALKQAVGQLMFQHDAFRMRYTQSESGWLQAMDAPSETIPFRVEDLSQLAPEEQSSAIEAIANETQTQLSLRAGQVVQTIYFHLGKEVPGRLLIVAHHLVVDGVSWRIILEDLQHAYQQIAAGQEVKLPAKTTSYKEWAQELERYAHSEAFKHEKSYWLSKSSVHSTELPADMPDSAENTEATVKSVHFSLTVEETKALLQQVPQAYRTQINDVLLAALAKALGQWTGKRSVFVNVEGHGREELAEHLDLSRTVGWFTSMYPVHLQWDETFSVRRALLTTKEELRAIPNKGLGYGVLRYLHAEQEIVDAISRIQADVLFNYMGKIDQIVGSDSLFGSAPESSGANLCPSAQRHHLLDVNSVVAGEQLHVTWRYSEKLQRESTIAAVAESFMAALREIVAHCTLPEAGGYSPSDFPLAVLEQKQIDKHIGFDRQ

SEQ ID NO: 77 - DNA, 3267 bp, Artificial Sequence
  synthetic
ccggaagcaggagggtactccccgtccgacttcccgttggctgtactggagcaaaagcagatcgacaaacacatcggtttcgaccggcaaatcgaggatgtgtacacgttgtctccgcttcagcaagggatgctgttccattccttgtacaaccaggacagcggcgattacgtcgtgcaatttgcggtcacgttccaaaatctggacgtgtctgtcctggaaaaagcgtggcaaaacgtgctggatcgccactccattttgcggacgcacttcgtttgggaaggactgagcgagccgcaccaggtcgtgcgaaaagacgtaaaagtcacgctcaccaaggaagactggcgccacctgcaagcagatgtgcaggacgagatgctggcagcttttctggaagaagaccgcagacgcagcttcgatattgcgcaagcgccattgtctcgctgggtcgtcttccagaccaaagacgaggagtatcgcttcgtctggagcttccatcacgttttgcttgacggttggagcgttccgatcgtgttgaacgaactgcttgcccactatgctgcaatcagcgaggggcgagaaggaaagcttgtgccttcgcagccgttctcccagtacattgcctggctgaagcgccaggatagggaaaaagcgaagccattctggacagatcagctaaaaggcttccacgagccgacttctttgggaatgggcaaaaatgttgccgcttcgcagcagaagcagtacaaggagcaaagcgtccttttgtcagaggaagcgaccgagcatttgcaaagcttcacgcgcgagcatcagctgacgctcaatacactcgtgcaaggggcatggggctggattttgggaagctacagtggggaagaggaagtgcttttcggggcgacaggttcagggcgtccggctgaccttcccggtgtcgagacgatggtcggttcgttcatcaatacgctgcctgtgcgggttccgttgcagacagatgcgaccttgcttgcctggctgaaagacttgcagcgacgacagttggaaattcgcgagtacgaatacacgccgctgttcgacatccagggctggagtgaactgccgcgcgggtctgcgctgtttgaatcgattctcgtgtttgagaactatccgactgtgcaagcagccaaaaaaggcgaagacgaggctgcatctgcgacatccggcgtttctctggaaattcacgatgtagcggcagtcgagcaaacgaactatccgctgacgttggtcgcagcgccaggcaaacaagtggcgttcaagttgaagtatgaccaggatcgcttcgatgacgccatgatcgagcgcgtgttgaaccagatgacccgtctgatggtctatatgagcaaatcgccggagctgcgtctgaatgacgtcgcgttgatggatgaagacgagcgcaagcaggtactgatcgactggaaccgcacggaaaaagagtatccgcgcgagctttgcctccatcacgcctttgaacagcaagcggcgaaaacgcccgaaaacattgcgcttgaatacaaagagcaaagcttgagctacgccggactgaacgagcgagcaaaccagctggctcatctgctgattgcccaaggcgttaagcctgacacgactgtagcgatttgcgtggagcgctccatggaaatgatcatcggcattctcggcgtgctgaaagcgggagctgcctatgtcccgattgatcctgcgcatcccgaagaacggatcgcctacatgctggatgactcgcaagcggtcgtcgtgctgacccaagcgggacttgcggacaagttcacgcaagcggcagctccggtcatttgcctgggcgagaagctgttcgcggatcgtgcgcatgtagacgtggacaacattcagacggatgttgcgtccacgaatctcgcttatgtcatctacacatcaggtacgaccgggctgccaaaaggggtagctgtcgagcatcgcagtgcgatgaacatggtgcaggcgtacatcgcctatttcggattggacgaatccagtcgcgtcctgcaattcacctcattcagcttcgacgtctccgtttcggaaatttggcaggcgctgctttcaggcgggacgctagtcattgaagatcgcgagtcgctgttgccagggccggacctcgtccgcacgttgcgcgagcgccgcatcagcaaagtatcgatggcatcctccttgctggcttcgctacctgtggcggaatacccggatctcgccgtgctggaagtagggggagatgcttgcagccgcgaactggttgcccgttatgcaacaggacgaaaatttttcaactgctacggcccgaccgaagcgacggtcggtaccgtgatcaaacagttgacgcttgacgacgataccccgacaatcggccgcccgttcccgaacaccaagctgtacgtgctggatcaaaaccgcaagcccgttcctgtcggcgtaccgggagagctgtacatcggcggcgagtgcctggcgcgcggatattggaaccgccccgagcttacagcggagcgttttgtcgccaatccattcggacaaccgggcgaacggctttaccggactggcgacctcgtgcgctacctgccggatggcaacgtcgactacctcggccgtttcgacgatcaggtaaaaattcgcggctatcgcatcgagctgggcgaaatcgcagaggcgctcagacagcacgcagcgatccgtgaagcagtcgtgcttgcgcgagaagtgcgaccgggtgacaagcgtttggctgcctatttgaccagcgccgccgagcaagaattgtccgtggacgagatcaagcaatggctcaaggaaaagctgccagactacatggttccggcgagctacacgtggcttccggccattccgctgaacgtgaacggaaaggtcgatcgcaaagcgttgccagctcctgattgggggcaaatcacggctgcgtacgtcgctccgcgcaacccgctggaagaaatgatcgccaacgtcttcgcagaagtgctcgccgtggaaaaagtcgggatcgacgacaactttttcgagctgggcggtcactccttgcttgcgacgcagacggtttctcgcctgcgggaaatcgttggcgtggaattgcagctgcgcacgttgtttgaacatccgacagtcgccgggcttggcgaacagctggagctgctcacgaagcagtcatcccgcaagctcgcgccaccgattggaaaagtatcccgcaag

SEQ ID NO: 78 - protein, 1089 aa, Artificial Sequence
  synthetic
PEAGGYSPSDFPLAVLEQKQIDKHIGFDRQIEDVYTLSPLQQGMLFHSLYNQDSGDYVVQFAVTFQNLDVSVLEKAWQNVLDRHSILRTHFVWEGLSEPHQVVRKDVKVTLTKEDWRHLQADVQDEMLAAFLEEDRRRSFDIAQAPLSRWVVFQTKDEEYRFVWSFHHVLLDGWSVPIVLNELLAHYAAISEGREGKLVPSQPFSQYIAWLKRQDREKAKPFWTDQLKGFHEPTSLGMGKNVAASQQKQYKEQSVLLSEEATEHLQSFTREHQLTLNTLVQGAWGWILGSYSGEEEVLFGATGSGRPADLPGVETMVGSFINTLPVRVPLQTDATLLAWLKDLQRRQLEIREYEYTPLFDIQGWSELPRGSALFESILVFENYPTVQAAKKGEDEAASATSGVSLEIHDVAAVEQTNYPLTLVAAPGKQVAFKLKYDQDRFDDAMIERVLNQMTRLMVYMSKSPELRLNDVALMDEDERKQVLIDWNRTEKEYPRELCLHHAFEQQAAKTPENIALEYKEQSLSYAGLNERANQLAHLLIAQGVKPDTTVAICVERSMEMIIGILGVLKAGAAYVPIDPAHPEERIAYMLDDSQAVVVLTQAGLADKFTQAAAPVICLGEKLFADRAHVDVDNIQTDVASTNLAYVIYTSGTTGLPKGVAVEHRSAMNMVQAYIAYFGLDESSRVLQFTSFSFDVSVSEIWQALLSGGTLVIEDRESLLPGPDLVRTLRERRISKVSMASSLLASLPVAEYPDLAVLEVGGDACSRELVARYATGRKFFNCYGPTEATVGTVIKQLTLDDDTPTIGRPFPNTKLYVLDQNRKPVPVGVPGELYIGGECLARGYWNRPELTAERFVANPFGQPGERLYRTGDLVRYLPDGNVDYLGRFDDQVKIRGYRIELGEIAEALRQHAAIREAVVLAREVRPGDKRLAAYLTSAAEQELSVDEIKQWLKEKLPDYMVPASYTWLPAIPLNVNGKVDRKALPAPDWGQITAAYVAPRNPLEEMIANVFAEVLAVEKVGIDDNFFELGGHSLLATQTVSRLREIVGVELQLRTLFEHPTVAGLGEQLELLTKQSSRKLAPPIGKVSRK

SEQ ID NO: 79 - DNA, 4437 bp, Artificial Sequence
  synthetic
acagtcgccgggcttggcgaacagctggagctgctcacgaagcagtcatcccgcaagctcgcgccaccgattggaaaagtatcccgcaaggagccgctgcctttgtcctttacgcagcagcgcttgtggttcctggagcaatttacgcaaaacagctcgatcaacaacattccgtctttcctgcgcatccagggcgagctcgacgtggccgcttgggaagcgagcttttccgcgatcattttgcgccacgaaagcttgcgaaccagcttcgaagttcgggacggccgacctgtgcaggtcattcagccgcatggcgattgggcaatgacccggatcgatctgcgtgcgctggagcctgccgaacgggaagcggaaatcaagcgcctggcagaacaggcgattgtccagccatttgacttgaccaaagggctgctgctccgggcgagtctggttcagctcgatgccaacgacttcgttttcctgttcgtcatgcaccacattgcgtcagacggatggtcgatgggaattttgctgagtgagcttatgaccaactacaaggcttttcgtcagggagaagcgtcaccgcttggggaattgccgatccagtacgcggatttcgccgtctggcaacgggaatggctgagcggagaagttctcgctgaacagctcggctactggcgagaaaaattgaagggcagcgagccgcttttgcaactgccgacagaccgcccgcgcccgcccgtccagacgtatgaaggggagaaaatgtccgtccagtttggagcggagcttttgaaacaattgcaaagcctgagccgaaaagaaggggcaaccttgttcatgacgctctttgccgcgttccaaactttgctgtaccgctacaccaaccaggacgacattctcgtcggaacgccgattgccggacgcaacaagcaagagacggagcagttgatcggctacttcatcaatacactcgtcctgcgcacggacatgtcgggccacccaagcttccgcgagctgcttgcgcgcgttcgcgaaaccgcgctggaagcttatgcgcaccaggatgttccgtttgaaaaactgctggacgagctgcaactggagcgcagcatgagctactctccgctgttccaggtgatgtttattttgcaaaacatcccggtacaggctgaacctgctggcgacattcaactgagcagctttgaccttgagctgggcgctgtcacctcgaagtttgacatgacggtgacgatggtggaaacaccggacggactgcttgccacgctagagtacaacaaggctctgtttgacagcagcacgatcactcgcatggtcgagcacttccacaagctgatggaagagatcgtagcgaacccggatcagtcgattacgttgcttccgcttatgcgcgaggaagaggagcagttgctgattacggaatggaaccgcacggaagtaccgtattcgcgggaaaaatgcgtccatgaaatgatcgaggaaatggtgagcaaagcaccggacagcatcgccctgatcgtgggtgagcagcgcgtaacgtacggcgagttgaacaggcaggcgaaccaactggcgcattatttgcgcaagcagggagttggcccggaagtgctcgtcggcatatgcgcagagcggacggtcgaaatgatgatcggacttttggcgatcctcaaggctggcggcgcttatgtgcccatcgatccggcgtatccggcagagcggattgcctacatcatcgggcattcgcaaattccggttctgcttacgcaagaacatctgctgccgacgctgcctgagcaccaggcgaaagtgatttgcctggatcgcgattgggcaacggtagcggttgagtccgaggaaaatccaggcaagcttgcgacctccgacaatttgatctacgtcatttacacatcaggctctaccggcaatccaaaaggggtggcactggaacaccgcagcgttatttacttcctctcttgggcgcatgacacttatacgcctgaggagatgagcggcgtcctgttctccacatcgatctgcttcgacttgtctgtgtacgagatgtttgccaccttgaccatgggcggcaaagtgatcatggcggaaaatgccttgcaactgccagccttgccagcagccgatcaggtgacgctcgtcaatacagtgccatcggccgcgacagagcttgtccgcatgaagggcataccggcttcggtgcgtgtcatcaacttgtgcggcgagccgctttccaaccgattggcacaagagctgtacgccttcccgcacgtggaaaaagtgttcaatctgtacgggccgacggaggataccgtttactccacacacgcgatcgtgacaaaaggagcgacgaacgagccgctaatcggcagaccgcagttcaatacgcacgtcttcgtgctggacagccaccgcaagcctgtgccagtaggggtgccgggggaattgtacctcagcggttccggcttggcgcgcggctacttgcaccgtcccgatctgaccgcagaacgttttgtgcaaaatccgttccgcgaaccgggagcgagaatgtaccggactggcgacctcgtgcgctacttgccggacggaaatctccagtttgtcggccgcgtcgattaccaggtgaaaatccgcggctaccgcatcgagctgggcgaaatcgagtccgtgctgaaccgcttcccgggcgtcaaagaggtcgtgctgctcgcccgtgaagatcgggaaggcgacaagtgcctggttgcgtacatcgtgttcgaggccgattgcacaagcaagattcacgatctgaatcactttttggccgacaagctgccagcgtacatgattccgcagcattacatgattttggacagcttgccgaagacgccaaacggcaaactggaccgcaaagcgctgccgaagccggaatacgaccgctcggaagcaggagtcgaatacgtcgcgccgcaaacgccagtggaaatcatgctgcacgcgcattgggctgcggtgctggaaatggaaacgatcggcgtgcacgacaatttctttgagatcggcggacactcgctgctcgctacgcaactgatttttaaagtgcgcgaagagctgcaactggaagtgccgttgcgcatcttgtttgagacgccgacgatcgcggggatggccaagacgatcgaggaaattatcaaacacggtttgacgtccgtttcccaggagatcgacgccaaaggtcttcaggatgaagtcgcgctcgatccggcgattttggccgaacagccgtacgaaggcgacccgagccagttccaggcggcgttattgacaggagctacaggcttcctcggagccttcctgctgcgcgacctgttgcagatgacagatgcagacatttactgcctcgttcgcgcttctggcgaagaagaaggactggcccgcctgcgcaaaacgttgcagctgtacgagctgtgggatgaagctcaggcacacagaatcattccggtaatcggcgatttggctcagccgcgactcgggctgtctgccgggcagtttgacgcgctggccgcaacagtcgatgtcatctaccacaacggcgccttggtcaacttcgtttatccgtacgccgccttgaaaaaggcaaacgtcatcggcacggaggaaattattcgcctggctgcggccaaaaagaccaagcctgtccacttcgtctcgacgattttcacctttgcctcggaggaaggcgaggaatccgtcgcggttcgcgaggaagacatgccggagaacagccgcatcctcacttccggctatacgcagagcaaatgggtcgccgagcacatcgtcaacctggctcgccagcgcggtattccgacagcgatctaccgttgcggccggatgacgggcgacagcgaaacaggggcatgccaaaaagacgacctgatgtggagaattgccgccggaatcatcgatttgggcaaagctcctgacatgagcggcgatttggacatgatgccagtcgattttgcaagtaaaggaatcgttcacctctccatgaccgagcacagcgtgaacagcaacttccacctgctcaatccgaacgcaaccgattacgacgacttgatcgcagccatcgagaacaaaggctttgagctggaacgagtcacgatggacgaatggatcgaagccgtgcaggaagacgcgaaggacaaaggcatggacgccaactcggccgcaccgctcggcaatctgttctcggacggtcacagcagcaggggcagcgtcgtttacgtcggcaataaaacgactcgtctgttgcgccaggctgacatcgagtgcccggaaatcgacgaagaagtgtttgcgaaagttctcgattactttgccagaaccggtcaattgcgtgtgacacaaaatacacggaac

SEQ ID NO: 80 - protein, 1479 aa, Artificial Sequence
  synthetic
TVAGLGEQLELLTKQSSRKLAPPIGKVSRKEPLPLSFTQQRLWFLEQFTQNSSINNIPSFLRIQGELDVAAWEASFSAIILRHESLRTSFEVRDGRPVQVIQPHGDWAMTRIDLRALEPAEREAEIKRLAEQAIVQPFDLTKGLLLRASLVQLDANDFVFLFVMHHIASDGWSMGILLSELMTNYKAFRQGEASPLGELPIQYADFAVWQREWLSGEVLAEQLGYWREKLKGSEPLLQLPTDRPRPPVQTYEGEKMSVQFGAELLKQLQSLSRKEGATLFMTLFAAFQTLLYRYTNQDDILVGTPIAGRNKQETEQLIGYFINTLVLRTDMSGHPSFRELLARVRETALEAYAHQDVPFEKLLDELQLERSMSYSPLFQVMFILQNIPVQAEPAGDIQLSSFDLELGAVTSKFDMTVTMVETPDGLLATLEYNKALFDSSTITRMVEHFHKLMEEIVANPDQSITLLPLMREEEEQLLITEWNRTEVPYSREKCVHEMIEEMVSKAPDSIALIVGEQRVTYGELNRQANQLAHYLRKQGVGPEVLVGICAERTVEMMIGLLAILKAGGAYVPIDPAYPAERIAYIIGHSQIPVLLTQEHLLPTLPEHQAKVICLDRDWATVAVESEENPGKLATSDNLIYVIYTSGSTGNPKGVALEHRSVIYFLSWAHDTYTPEEMSGVLFSTSICFDLSVYEMFATLTMGGKVIMAENALQLPALPAADQVTLVNTVPSAATELVRMKGIPASVRVINLCGEPLSNRLAQELYAFPHVEKVFNLYGPTEDTVYSTHAIVTKGATNEPLIGRPQFNTHVFVLDSHRKPVPVGVPGELYLSGSGLARGYLHRPDLTAERFVQNPFREPGARMYRTGDLVRYLPDGNLQFVGRVDYQVKIRGYRIELGEIESVLNRFPGVKEVVLLAREDREGDKCLVAYIVFEADCTSKIHDLNHFLADKLPAYMIPQHYMILDSLPKTPNGKLDRKALPKPEYDRSEAGVEYVAPQTPVEIMLHAHWAAVLEMETIGVHDNFFEIGGHSLLATQLIFKVREELQLEVPLRILFETPTIAGMAKTIEEIIKHGLTSVSQEIDAKGLQDEVALDPAILAEQPYEGDPSQFQAALLTGATGFLGAFLLRDLLQMTDADIYCLVRASGEEEGLARLRKTLQLYELWDEAQAHRIIPVIGDLAQPRLGLSAGQFDALAATVDVIYHNGALVNFVYPYAALKKANVIGTEEIIRLAAAKKTKPVHFVSTIFTFASEEGEESVAVREEDMPENSRILTSGYTQSKWVAEHIVNLARQRGIPTAIYRCGRMTGDSETGACQKDDLMWRIAAGIIDLGKAPDMSGDLDMMPVDFASKGIVHLSMTEHSVNSNFHLLNPNATDYDDLIAAIENKGFELERVTMDEWIEAVQEDAKDKGMDANSAAPLGNLFSDGHSSRGSVVYVGNKTTRLLRQADIECPEIDEEVFAKVLDYFARTGQLRVTQNTRN

SEQ ID NO: 81 - DNA, 3294 bp, Artificial Sequence
  synthetic
atgttaaacagttctaaaagtatattgattcatgctcaaaataaaaatggaacgcatgaagaggagcagtatctctttgctgtgaacaacaccaaagcggagtatccacgtgataagacgatccatcagttatttgaagagcaggttagtaagagaccaaacaatgtagccattgtatgtgaaaatgagcaacttacctaccatgagcttaatgtgaaagccaatcaactagcacggatttttatagaaaaagggattggaaaagacactcttgttggaattatgatggagaaatctatcgatttatttataggcatattagccgttttaaaagcaggtggagcatatgttccgattgatattgaatatcctaaggaaagaattcaatatattcttgatgatagtcaggcaagaatgctacttacccagaagcatttggttcatttaattcataatattcaatttaatgggcaagtggaaatttttgaagaagatactatcaaaattagagaaggaactaatctacatgtaccaagtaaatcaaccgatcttgcttatgttatttatacttctggtacaacaggcaatccaaaaggtacaatgctggagcataaaggaataagtaatctaaaggtatttttcgaaaatagtcttaacgtgactgaaaaggatagaattggtcaatttgccagcatctcttttgatgcatctgtatgggagatgtttatggctttgttaacgggggctagcctgtatattatcctgaaggatacaatcaatgattttgtgaagtttgaacaatacattaaccaaaaggaaatcactgttattacgttaccacctacctatgtagttcatcttgatccagaacgtattttatcgatacaaacgttaattacagcaggctcagctacctcgccttccttagtaaacaagtggaaggagaaagtaacttacataaatgcctatggccctacggaaacaactatttgtgcgactacatgggtagccaccaaagaaacaataggtcattcagttccaatcggagcaccaattcaaaatacacaaatttatattgtcgatgaaaatcttcaattaaaatcggttggtgaagctggtgaattgtgtattggtggagaagggttagcaaggggatattggaagcgaccggaattaacttcccagaagttcgttgataacccgtttgttccaggagagaagttgtataaaacaggagatcaggcaagatggctatctgatggaaatattgaatatctcggaagaatagataaccaggtaaagattagaggtcaccgagttgaactagaagaagttgagtctattcttctaaagcatatgtatattagcgaaactgcagtaagtgtgcataaagatcaccaagaacagccgtatttgtgcgcttattttgtatcggaaaagcatataccactagaacagttaagacaattctcatcagaagaactgccaacgtatatgatcccttcttattttatccagttagacaaaatgccgcttacatcaaatgggaagattgatcgaaagcagttgccggaacctgatttaactttcgggatgagggtagactatgaagcgccgcgaaatgaaatcgaggaaacgcttgttactatctggcaggatgtattaggtattgagaaaatcggtattaaagataatttctatgcattaggtggagattctattaaagcaatacaggttgctgctcgcctgcattcctaccaattaaagctagaaacaaaagatttattaaagtatccaacaatcgatcaactcgttcattatataaaagatagtaaaagaagaagtgagcaaggtattgtggaaggtgagattggacttacacctattcagcattggttctttgaacaacaatttacaaatatgcaccattggaaccaatcgtatatgttgtatagaccaaatgggtttgataaagagatcttgctaagggtatttaataaaattgttgagcatcatgatgcattacgtatgatatacaaacatcataacggaaagatcgtgcagataaatcgggggcttgaaggtacgttgtttgatttttatacctttgatttaactgcaaatgataatgagcaacaggtgatttgtgaagaatctgctcgattacaaaatagtataaacttggaagtaggccctctagtaaagatagcgctgtttcatactcagaatggagatcacctgtttatggctattcatcatttggttgtggatggtatttcttggaggattttgtttgaggatttggccacagcttatgaacaagcaatgcatcagcaaacgattgctttaccagagaaaacagattcatttaaggactggtctattgaattagaaaaatatgcgaacagcgaattattcctagaagaagctgaatattggcatcatttgaattattataccgagaacgttcaaattaagaaagattatgtcaccatgaacaataaacaaaagaatatacgttatgtaggaatggagttaacaatagaagagacagaaaaattattgaaaaatgtaaataaagcgtatcgaacagaaattaatgatattttattaacggcacttggctttgcactcaaagaatgggccgatattgataaaattgtaattaacttagagggacacggacgggaagaaatactggaacagatgaacattgcaaggacggtaggctggtttacttcccagtatcctgttgtacttgatatgcaaaaatcggatgatttgtcttatcaaatcaaattaatgaaagaaaatttacgcagaatacctaacaaaggaatcggatatgaaatttttaagtatttaacaactgaatatttacggcctgttttaccctttacattaaagccggaaattaactttaactacttaggacagttcgatacggacgtgaagactgaattgtttactcgttctccttatagcatgggtaattcattaggaccagatggaaaaaataatttaagcccagaaggggaaagttattttgtactcaatattaatggttttattgaagaaggtaagcttcacatcaccttttcttataatgaacagcagtataaggaggataccattcagcaattgagccggagctataagcaacatcttttggccatcattgaacattgtgtacagaaggaagatactgagttaactccaagtgatttcagtttcaaggaacttgaattagaagagatggatgatattttcgatttgttggccgattcattaacg

SEQ ID NO: 82 - protein, 1098 aa, Artificial Sequence
  synthetic
MLNSSKSILIHAQNKNGTHEEEQYLFAVNNTKAEYPRDKTIHQLFEEQVSKRPNNVAIVCENEQLTYHELNVKANQLARIFIEKGIGKDTLVGIMMEKSIDLFIGILAVLKAGGAYVPIDIEYPKERIQYILDDSQARMLLTQKHLVHLIHNIQFNGQVEIFEEDTIKIREGTNLHVPSKSTDLAYVIYTSGTTGNPKGTMLEHKGISNLKVFFENSLNVTEKDRIGQFASISFDASVWEMFMALLTGASLYIILKDTINDFVKFEQYINQKEITVITLPPTYVVHLDPERILSIQTLITAGSATSPSLVNKWKEKVTYINAYGPTETTICATTWVATKETIGHSVPIGAPIQNTQIYIVDENLQLKSVGEAGELCIGGEGLARGYWKRPELTSQKFVDNPFVPGEKLYKTGDQARWLSDGNIEYLGRIDNQVKIRGHRVELEEVESILLKHMYISETAVSVHKDHQEQPYLCAYFVSEKHIPLEQLRQFSSEELPTYMIPSYFIQLDKMPLTSNGKIDRKQLPEPDLTFGMRVDYEAPRNEIEETLVTIWQDVLGIEKIGIKDNFYALGGDSIKAIQVAARLHSYQLKLETKDLLKYPTIDQLVHYIKDSKRRSEQGIVEGEIGLTPIQHWFFEQQFTNMHHWNQSYMLYRPNGFDKEILLRVFNKIVEHHDALRMIYKHHNGKIVQINRGLEGTLFDFYTFDLTANDNEQQVICEESARLQNSINLEVGPLVKIALFHTQNGDHLFMAIHHLVVDGISWRILFEDLATAYEQAMHQQTIALPEKTDSFKDWSIELEKYANSELFLEEAEYWHHLNYYTENVQIKKDYVTMNNKQKNIRYVGMELTIEETEKLLKNVNKAYRTEINDILLTALGFALKEWADIDKIVINLEGHGREEILEQMNIARTVGWFTSQYPVVLDMQKSDDLSYQIKLMKENLRRIPNKGIGYEIFKYLTTEYLRPVLPFTLKPEINFNYLGQFDTDVKTELFTRSPYSMGNSLGPDGKNNLSPEGESYFVLNINGFIEEGKLHITFSYNEQQYKEDTIQQLSRSYKQHLLAIIEHCVQKEDTELTPSDFSFKELELEEMDDIFDLLADSLT

SEQ ID NO: 83 - DNA, 3174 bp, Artificial Sequence
  synthetic
atgagtacatttaaaaaagaacatgttcaggatatgtatcgtttatctcccatgcaggaaggcatgttgtttcacgcattacttgataaagataaaaatgctcacctggtacaaatgtctatcgcgatcgaaggtatcgtggatgtggagctgcttagtgaaagcttgaacatattgattgatagatacgatgtgtttagaacaacattcttacatgaaaaaattaaacaaccgcttcaggtagtgctaaaggaacggcctgttcagcttcaatttaaagacatatcatccttagatgaagaaaaaagagaacaggctattgagcagtataagtatcaagatggggaaacagtctttgatttaacaagagatcccttgatgagagtagctatttttcaaactggtaaggttaactaccaaatgatctggagcttccaccatattttaatggatggttggtgcttcaacattatatttaatgacttgttcaatatatatctgtcattaaaagagaagaaacctcttcagttagaggcggtgcaaccatataagcagtttattaagtggcttgaaaaacaagataaacaggaagctcttcgctactggaaagaacatttaatgaattatgatcaatcagtaacattacctaaaaagaaagcagctattaataatactacatatgaaccagcacagtttcgttttgcgtttgacaaagtgcttacccagcagctgcttcgtattgccaatcaaagccaagtaacactaaatattgtttttcaaacaatatgggggattgtacttcaaaaatacaattccactaatcatgttgtatatggctctgttgtatcaggccgtccttctgaaatatcgggaattgagaaaatggttggactatttattaatactcttccattacgtatccaaacgcaaaaagatcaatcatttattgaattagtaaagactgttcatcaaaacgtccttttctcgcaacagcatgagtattttccattgtatgaaatacaaaatcatacagaattaaaacagaatctgattgatcatattatggtaattgaaaattatcctttagtagaagaattgcaaaagaatagtatcatgcaaaaagtagggtttacagttcgtgatgtcaaaatgtttgaaccaactaattatgatatgacagttatggttttacctcgtgatgaaattagtgtccgactcgattataacgcagccgtttatgatatagatttcataaaaaaaattgaaggtcacatgaaagaagtggctttatgcgtggcaaataatccacatgtgttagtacaggacgttcctctgcttacaaagcaagaaaaacaacatttattggtagagctgcatgattcgataacagagtatcctgataagacgattcatcagttatttacagaacaggtagaaaaaacaccagagcatgtggcagttgtattcgaagatgagaaagtgacctatagagagctgcatgagagatctaatcaattagccagattcttaagagaaaaaggcgtaaaaaaagaaagcatcataggcattatgatggagcgttcagttgaaatgattgttgggatcttagggattttaaaagctggtggagcttttgtgcctattgatcctgaatatccaaaagaaagaatcggctatatgttagattctgtacggctagtacttacacaacgccatttaaaggataaatttgcttttacgaaagaaacgatagtaattgaagatccaagtatttcacacgagttaactgaagaaatagattatattaatgaatcagaggacttgttttatattatttatacatcaggaacaacaggtaaaccaaaaggggttatgctagagcacaaaaacatcgttaatctgcttcattttactttcgagaaaacaaatatcaactttagtgacaaagtattacagtatacaaatgcagttttgacgtgtgttaccaagaaatttttttcgacgctcttgtctggagggcaattatatcttattaggaaagaaactcaacgcgatgtagagcaattatttgatttagtaaaacgtgaaaatattgaagtattatcctttcctgtggcttttctaaaatttattttcaatgaaagagaatttatcaatcgttttccaacttgcgtgaaacatattatcacagcaggagaacaattagtagttaacaatgagtttaaacgttatttgcatgaacataacgtacatttacacaatcattatggtccatcagaaacgcatgttgttaccacctatactattaatcctgaagctgaaattcctgaattaccaccgataggaaaacctatctccaatacatggatttatattttggatcaagaacaacaactacaaccacaaggaattgtaggagagttatatatttcgggcgcaaatgttggaagaggatatttgaataatcaagaattaacggcagaaaaattctttgcagatccctttaggccaaacgaacggatgtaccgaacaggggatttagcaaggtggttgccagacggaaatatcgaatttttaggaagagccgatcatcaggtgaaaattagggggcatcgaatagagcttggtgagatcgaggcacaattattaaattgtaagggtgtaaaagaagctgttgttatcgataaagcggatgataaaggcggaaaatatttatgtgcctatgttgttatggaagtagaagtaaatgactctgagcttcgagaatatttggggaaagctttgcctgattatatgatcccgtcgttctttgttccgttggatcacgtccgcttacacctaaacggaaaaatagacagaaaatctcttccgaatctagaggggattgtgaatacaaacgcaaaatatgtagtacctacaaatgagctggaagaaaaattggctaaaatctgggaagaagtacttgggatttctcagatcggtatacaagacaatttcttttcgttaggcgggcattctcttaaagccattacgcttatttcccgtatgaacaaagagtgtaatgtagacattcctctacgtttgttatttgaagcaccaaccattcaggaaatctctaattatataaacggggcaaagaaagaaagctatgttgccattcagcctgtaccagaa

SEQ ID NO: 84 - protein, 1058 aa, Artificial Sequence
  synthetic
MSTFKKEHVQDMYRLSPMQEGMLFHALLDKDKNAHLVQMSIAIEGIVDVELLSESLNILIDRYDVFRTTFLHEKIKQPLQVVLKERPVQLQFKDISSLDEEKREQAIEQYKYQDGETVFDLTRDPLMRVAIFQTGKVNYQMIWSFHHILMDGWCFNIIFNDLFNIYLSLKEKKPLQLEAVQPYKQFIKWLEKQDKQEALRYWKEHLMNYDQSVTLPKKKAAINNTTYEPAQFRFAFDKVLTQQLLRIANQSQVTLNIVFQTIWGIVLQKYNSTNHVVYGSVVSGRPSEISGIEKMVGLFINTLPLRIQTQKDQSFIELVKTVHQNVLFSQQHEYFPLYEIQNHTELKQNLIDHIMVIENYPLVEELQKNSIMQKVGFTVRDVKMFEPTNYDMTVMVLPRDEISVRLDYNAAVYDIDFIKKIEGHMKEVALCVANNPHVLVQDVPLLTKQEKQHLLVELHDSITEYPDKTIHQLFTEQVEKTPEHVAVVFEDEKVTYRELHERSNQLARFLREKGVKKESIIGIMMERSVEMIVGILGILKAGGAFVPIDPEYPKERIGYMLDSVRLVLTQRHLKDKFAFTKETIVIEDPSISHELTEEIDYINESEDLFYIIYTSGTTGKPKGVMLEHKNIVNLLHFTFEKTNINFSDKVLQYTNAVLTCVTKKFFSTLLSGGQLYLIRKETQRDVEQLFDLVKRENIEVLSFPVAFLKFIFNEREFINRFPTCVKHIITAGEQLVVNNEFKRYLHEHNVHLHNHYGPSETHVVTTYTINPEAEIPELPPIGKPISNTWIYILDQEQQLQPQGIVGELYISGANVGRGYLNNQELTAEKFFADPFRPNERMYRTGDLARWLPDGNIEFLGRADHQVKIRGHRIELGEIEAQLLNCKGVKEAVVIDKADDKGGKYLCAYVVMEVEVNDSELREYLGKALPDYMIPSFFVPLDHVRLHLNGKIDRKSLPNLEGIVNTNAKYVVPTNELEEKLAKIWEEVLGISQIGIQDNFFSLGGHSLKAITLISRMNKECNVDIPLRLLFEAPTIQEISNYINGAKKESYVAIQPVPE

SEQ ID NO: 85 - DNA, 3201 bp, Artificial Sequence
  synthetic
ttatttgaagcaccaaccattcaggaaatctctaattatataaacggggcaaagaaagaaagctatgttgccattcagcctgtaccagaacaagagtactatcctgtatcatcagttcaaaaaagaatgtttattcttaatgaatttgatcgttcaggtacggcctataatttacctggtgttatgtttctagatggaaaattgaactaccgacaattggaagcagcggtaaaaaaattagttgagcgacatgaagcgctgcgtacttcctttcattcaattaatggggaaccagttcagcgggtgcatcaaaatgtagaactgcagattgcttattcagagtcaacggaagatcaggtggagcgaattattgcggaatttatgcaaccatttgctcttgaagttcgtccgttacttcgtgtaggtcttgttaaattggaggcagaacgtcatctatttataatggatatgcatcatatcatctcggatggggtatccatgcagatcatgattcaagaaattgctgatttgtataaagaaaaggaacttcctacgttaggcattcaatataaagactttactgtttggcataatcgcttgcttcaatcggatgttattgaaaaacaagaagcttcactggctgaacgtatttgcagaagagattccagtattgaatctaccgaccgattacccaagtaccaaccattcaaagctttgatggtaaaagatttacattcagtacaggaaagcagcttatggatgatttatacaaggtggcaacagaaacaggaacaacactatatatggttttacttgctgcgtataatgtttttcttatcgaagtattccgggcaagatgacatcgttgtaggaacaccgattgctggtaggtctcatgctgatgtggaaaatatgctggggatgtttgtaaatacattagcaataagaagtcgtttaaataatgaggatacttttaaagattttttagcaaatgtaaaacaaacggctttgcatgcctatgaaaatccagattacccatttgatacgcttgtcgaaaagttgggtatacagagagatttaagtagaaatccattatttgatacgatgtttgttttgcaaaatacggatagaaagtcttttgaggttgaacagataacgattacaccatatgttccaaatagcagacattctaaatttgatcttacattagaggttagcgaagaacaaaatgagattttattatgcctagaatattgcactaaattatttacggataaaacagttgaaagaatggctggtcattttttacagatcttgcatgcaattgttgggaacccaacgattataatatcagaaatcgagatattgtctgaagaagaaaaacaacatattttattcgagttcaacgatacgaaaaccacatatccactatgcaaacaattcaaggattatttgaggaacaggtggagaagacgcgccgaccatgttgcagttggatggaaagaccaaacattaacgtatcgggaacttaacgaaagagcgaatcaggtcgcaagagtcttacggcaaaaaggagtccaacccgataatatcgtgggattgctggttgagcgttcacctgaaatgctcgtgggtatcatgggaattcttaaagcagggggagcttatttacctcttgatccggagtacccagcggatagaatttcgtacatgatacaagattgtggtgtacgcattatgcttacccaacagcatcttttatctttagtacatgatgaatttgattgtgttattttggatgaagacagtttgtacaagggggattcttccaatttggctccggttaaccaggccggggatttagcctacatcatgtacacttctggttctacaggaaagcctaaaggtgttatggtagaacatcgaaatgtgattcgccttgtgaaaaatacaaattatgttcaggtccgcgaagacgatcgtataatacagaccggagcaattggattcgatgcactgacatttgaagtttttggctcattgctgcatggagctgaattgtatcctgttactaaagacgtgctattagatgcagagaaactacacaaatttttacaagcgaatcaaattacgattatgtggttaacttctccgttatttaaccaattgtcacaaggaaccgaagagatgtttgctggccttcgctccctaattgtaggtggagatgccttgtctccgaaacacatcaataatgtaaagcgaaaatgccctaatctgactatgtggaacggttacggcccaacagaaaacaccactttttctacatgctttcttattgataaagaatatgatgacaatattccgatagggaaggccattagtaattcaacagtgtatatcatggaccggtatggccagcttcagccggtgggtgtaccaggagaattatgtgtaggaggggatggggttgccaggggatatatgaatcagcctgcattaacagaagagaagtttgtcccaaatccattcgctcctggtgagagaatgtatcgcacgggggatttggcaagatggttgcctgatggaacaattgagtatttaggtcgtattgatcagcaggtgaaaatcaggggctaccgtattgaaccgggagagattgaaacgcttcttgtgaagcacaaaaaagtcaaagaatcggtaatcatggtagtagaggataataatggacaaaaggctctatgcgcttattacgttccggaagaagaagtaacggtatctgaactgagggaatatatagctaaagagttgcctgtttacatggttccagcctattttgtacagattgaacaaatgcctcttacacagaacggtaaagtaaatcgaagcgcgttaccaaaaccagatggtgaatttggtacagcaaccgaatatgtagcgcctagcagcgacattgaaatgaagctggcagagatttggcataatgtgttaggggtaaacaaaatcggggtactggataacttctttgaattaggtggtcattcattaagagctatgacaatgatttcccaggtacataaagagttcgacgttgaattgccattaaaagtgttatttgaaacaccaacgatctctgcattagctcaatacattgctgatggacaaaaaggaatgtacctggccattcaacctgttaccccgacg

SEQ ID NO: 86 - protein, 1067 aa, Artificial Sequence
  synthetic
LFEAPTIQEISNYINGAKKESYVAIQPVPEQEYYPVSSVQKRMFILNEFDRSGTAYNLPGVMFLDGKLNYRQLEAAVKKLVERHEALRTSFHSINGEPVQRVHQNVELQIAYSESTEDQVERIIAEFMQPFALEVRPLLRVGLVKLEAERHLFIMDMHHIISDGVSMQIMIQEIADLYKEKELPTLGIQYKDFTVWHNRLLQSDVIEKQEASLAERICRRDSSIESTDRLPKYQPFKALMVKDLHSVQESSLWMIYTRWQQKQEQHYIWFYLLRIMFFLSKYSGQDDIVVGTPIAGRSHADVENMLGMFVNTLAIRSRLNNEDTFKDFLANVKQTALHAYENPDYPFDTLVEKLGIQRDLSRNPLFDTMFVLQNTDRKSFEVEQITITPYVPNSRHSKFDLTLEVSEEQNEILLCLEYCTKLFTDKTVERMAGHFLQILHAIVGNPTIIISEIEILSEEEKQHILFEFNDTKTTYPLCKQFKDYLRNRWRRRADHVAVGWKDQTLTYRELNERANQVARVLRQKGVQPDNIVGLLVERSPEMLVGIMGILKAGGAYLPLDPEYPADRISYMIQDCGVRIMLTQQHLLSLVHDEFDCVILDEDSLYKGDSSNLAPVNQAGDLAYIMYTSGSTGKPKGVMVEHRNVIRLVKNTNYVQVREDDRIIQTGAIGFDALTFEVFGSLLHGAELYPVTKDVLLDAEKLHKFLQANQITIMWLTSPLFNQLSQGTEEMFAGLRSLIVGGDALSPKHINNVKRKCPNLTMWNGYGPTENTTFSTCFLIDKEYDDNIPIGKAISNSTVYIMDRYGQLQPVGVPGELCVGGDGVARGYMNQPALTEEKFVPNPFAPGERMYRTGDLARWLPDGTIEYLGRIDQQVKIRGYRIEPGEIETLLVKHKKVKESVIMVVEDNNGQKALCAYYVPEEEVTVSELREYIAKELPVYMVPAYFVQIEQMPLTQNGKVNRSALPKPDGEFGTATEYVAPSSDIEMKLAEIWHNVLGVNKIGVLDNFFELGGHSLRAMTMISQVHKEFDVELPLKVLFETPTISALAQYIADGQKGMYLAIQPVTPT

SEQ ID NO: 87 - DNA, 3225 bp, Artificial Sequence
  synthetic
tttgaaacaccaacgatctctgcattagctcaatacattgctgatggacaaaaaggaatgtacctggccattcaacctgttaccccgacggattactatccagtatcatctgcgcaaaagaggatgtacatcctttatgaatttgaaggggctggcattacctataatgtacctaatgtaatgtttatagaaggaaagctggattatcagcgctttgaatacgctataaaaagtttggtaaatcgacatgaggcgcttcgaacgtctttctattcgcttaatggagaaccagttcagcgtgtacatcaaaatgtagagctacagattgcttattcggaggcgaaagaagatgagatagagcaaattgtagaaagctttgttcaaccatttgaccttgaaatagctccgctgcttcgcgtagggcttgttaaattggcatcggatcgctatttattcctaatggatatgcatcatattatctcagatggtgtatcaatgcaaattataacaaaagaaattgccgacttatataaaggaaaagagcttgctgaactgcatattcagtataaagattttgctgtatggcaaaacgaatggtttcaatctgacgctcttgaaaaacagaaaacgtattggttgaacacctttgcagaggatattccggttttaaatttgtcaactgattatccaagaccgacaattcaaagttttgaaggagatattgtcacgtttagtgcagggaagcaacttgcggaagaattgaaacgcctggctgcagaaacagggacgactttgtatatgcttctgttagcggcgtacaatgtacttttacacaaatactcgggacaggaagaaattgtagtaggaacgcctattgccgggcgatctcacgcagatgtggaaaatattgttgggatgtttgtcaatacgcttgcattgaaaaatacccctatagccgtacgcaccttccacgaattcctgttggaagtaaaacaaaatgctttagaagcttttgaaaatcaagactatccatttgaaaatttgatagagaagctgcaagtgcgtcgcgacttaagtcgcaatccattatttgatacaatgtttagcctaagcaatattgacgaacaagtagagatagggattgagggattgaacttcagcccatatgaaatgcagtattggattgcaaaatttgatatttcattcgatattttagaaaagcaagatgacattcaattttattttaactattgcacgaatctgtttaaaaaagaaacgatagaacgattagcgacacactttatgcatattttacaggagattgttattaatcctgagattaagttatgtgaaattaatatgctgtccgaagaagaacagcagcgtgtcctgtatgactttaatggcacagatgcaacctacgctacgaataaaatattccatgagttatttgaagaacaggttgaaaaaacaccagatcatatagcggtgatagatgaaagagaaaagctttcctatcaggagcttaatgcgaaagcgaatcagctggcacgagtgctgcgccaaaaaggagtacagcctaatagcatggtaggtattatggtagatcgctcactcgacatgattgtaggaatgcttggggttttaaaagcaggaggagcatatgtgcctatcgatatagactatcctcaggaacggattagctacatgatggaagatagtggtgcagcgctcttgttaacacaacaaaagttgacacagcaaattgcgttttctggtgacattttgtatcttgaccaagaagaatggcttcatgaggaagcttcaaatttagaacccatcgctcgtccgcattatatagcctatatcatttacacttctggtacaaccggaaagccaaaaggtgtgatgattgagcatcaaagctatgtgaatgtagcaatggcatggaaagatgcctatcggttagatacattcccggtccgtttgcttcagatggctagctttgcctttgcctttgacgtatctgcaggtgattttgccagagcactacttacaggtgggcaattaattgtatgtccaaatgaagtaaagatggacccagcttctttatatgccattattaagaaatatgacattactatttttgaagcaacgcctgctctagtgattccattgatggagtatatttatgaacagaagctggatattagccagttacagattctgattgtcggatcggacagttgttcgatggaagactttaaaaccttggtttcccgttttggttcaactatacgtattgtgaatagctatggagtaaccgaagctgcattgattctagctattatgaaccaaccgctttcttcgttacatgtaacaggaactgtaccgattggaaaaccgtacgctaacatgaaaatgtatattatgaatcaatatttgcagattcagcctgtaggtgtaattggagaattatgtattggaggagccggggttgcccgtggatatttaaatagaccggacttaacagcagaaaagtttgtccctaatccttttgttccaggtgaaaagctgtatcgaacaggcgacttggcaagatggatgccggatgggaatgttgagtttcttggtcgaaatgaccatcaggtgaaaatcagagggattcgaatcgagcttggagaaatcgaagcacaactgcgtaaacatgatagcataaaagaagcaactgtgatcgcaagagaagatcacatgaaagagaaatatttatgtgcgtatatggtgaccgaaggagaagtaaatgtagctgaactgcgtgcgtatctagcaaatgatcgtgcggcaatgattccgtcatattttgtatcgctcgaagcaatgccacttactgctaatggaaaaattgataagcgatctttaccagagcccgatggttccatatcgataggaacagaatatgatcgtccgcgtaccatgcttgagggaaaactagaagagatatggaaagatgtattgggtttacagcgtgttggcattcacgatgacttctttacaataggtggccattcattgaaggctatggctgttatttcgcaagttcataaagaatgccagactgaagttcctctgcgtgtcttatttgaaacacctaccattcaaggactggctaaatatatagaggagacggacacagagcaatatatggctattcagccggttagcgga

SEQ ID NO: 88 - protein, 1075 aa, Artificial Sequence
  synthetic
FETPTISALAQYIADGQKGMYLAIQPVTPTDYYPVSSAQKRMYILYEFEGAGITYNVPNVMFIEGKLDYQRFEYAIKSLVNRHEALRTSFYSLNGEPVQRVHQNVELQIAYSEAKEDEIEQIVESFVQPFDLEIAPLLRVGLVKLASDRYLFLMDMHHIISDGVSMQIITKEIADLYKGKELAELHIQYKDFAVWQNEWFQSDALEKQKTYWLNTFAEDIPVLNLSTDYPRPTIQSFEGDIVTFSAGKQLAEELKRLAAETGTTLYMLLLAAYNVLLHKYSGQEEIVVGTPIAGRSHADVENIVGMFVNTLALKNTPIAVRTFHEFLLEVKQNALEAFENQDYPFENLIEKLQVRRDLSRNPLFDTMFSLSNIDEQVEIGIEGLNFSPYEMQYWIAKFDISFDILEKQDDIQFYFNYCTNLFKKETIERLATHFMHILQEIVINPEIKLCEINMLSEEEQQRVLYDFNGTDATYATNKIFHELFEEQVEKTPDHIAVIDEREKLSYQELNAKANQLARVLRQKGVQPNSMVGIMVDRSLDMIVGMLGVLKAGGAYVPIDIDYPQERISYMMEDSGAALLLTQQKLTQQIAFSGDILYLDQEEWLHEEASNLEPIARPHYIAYIIYTSGTTGKPKGVMIEHQSYVNVAMAWKDAYRLDTFPVRLLQMASFAFAFDVSAGDFARALLTGGQLIVCPNEVKMDPASLYAIIKKYDITIFEATPALVIPLMEYIYEQKLDISQLQILIVGSDSCSMEDFKTLVSRFGSTIRIVNSYGVTEAALILAIMNQPLSSLHVTGTVPIGKPYANMKMYIMNQYLQIQPVGVIGELCIGGAGVARGYLNRPDLTAEKFVPNPFVPGEKLYRTGDLARWMPDGNVEFLGRNDHQVKIRGIRIELGEIEAQLRKHDSIKEATVIAREDHMKEKYLCAYMVTEGEVNVAELRAYLANDRAAMIPSYFVSLEAMPLTANGKIDKRSLPEPDGSISIGTEYDRPRTMLEGKLEEIWKDVLGLQRVGIHDDFFTIGGHSLKAMAVISQVHKECQTEVPLRVLFETPTIQGLAKYIEETDTEQYMAIQPVSG

SEQ ID NO: 89 - DNA, 4026 bp, Artificial Sequence
  synthetic
ttatttgaaacacctaccattcaaggactggctaaatatatagaggagacggacacagagcaatatatggctattcagccggttagcggacaggactattatccagtatcatcagcacaaaagagaatgtttattgttaatcaatttgttggagtaggaattagctacaatatgccttccatcatgctgattgaaggaaaacttgagcgaacacgcttggaatcagcatttaaaagattgatagaacgacatgagagccttcgaacatcttttgaaataataaatggtaagcctgtacagaagattcatgaggaagttgatttcaatatgtcctatcaggtggcttctaatgaacaagtagagaagatgatcgatgagttcattcagcctttcgatttaagtgttgcaccgctgcttcgtgtggaacttttaaaattggaagaagaccgtcatgtgcttatatttgatatgcatcatattatctcagatggtatatcttccaatattttgatgaaagaattaggagaactatatcaaggtaatgctttaccagaacttcgtattcaatacaaggatttcgctgtatggcaaaatgagtggttccagtcagaagcctttaaaaagcaagaagaatactgggtaaatgtcttcgcagatgaacgcccgattctggatataccgacggattatccaaggccgatgcaacaaagctttgatggtgctcaacttacatttggaaccggaaagcagcttatggatgggttatacagggtagcaacggaaacgggaacaacgctttatatggttttgcttgcggcatataatgttcttctttccaaatattctggtcaagaagatattattgtagggacaccgattgtgggtagatcccatactgaccttgagaatattgtcgggatgtttgtcaacacgttagcaatgagaaataaaccggaaggagaaaagacgttcaaagcatttgtatcagaaataaagcagaatgcactagcggcttttgagaatcaggattatccatttgaagagcttatcgaaaaactagagatacaaagggacttaagcagaaatccattatttgatacgctctttagccttcaaaacataggtgaagaatcatttgaactagccgaattaacatgcaaacctttcgatttggtaagcaaattagagcatgccaagtttgatctgagtcttgtggcagtagtttttgaggaagaaattgcatttgggcttcaatactgcacaaaactgtataaggaaaaaacagttgaacaactggctcaacattttatacaaatagtaaaagcaattgtagaaaatccagatgtcaaattatctgatattgatatgttatctgaagaagagaagaaacaaatcatgcttgagttcaatgatacgaaaatacaatatacgcagaatcaaacaatacaggaattgtttgaagagcaagtgaagaaaacacctgaacatatagcaatcgtatgggaagggcaagcattaatctatcatgagctaaatataaaagctaatcagttagctcgtgtattacgagaaaaaggggtaacccctaatcatcctgtagcgattatgacggaacgctcattagagatgatcgtaggtatctttagtattttgaaagcaggaggagcatatgttccaattgatccagcctatccacaagaacgtattcaatacttgcttgaagatagcggagcagcgctactgcttactcagtcacatgtattaaataaattaccggtcgatatcgaatggttggatcttacagatgaacaaaactatgtagaagatggtaccaatcttccatttatgaatcagtcaacagatctcgcctatattatttatacatccggtacaacaggcaagcctaaaggggttatgattgaacatcaaagcatcatcaactgcctgcaatggcggaaggaagaatacgaatttggaccaggggatacggctctacaagtgttttcctttgcttttgatggatttgtagcaagtttgtttgctccgattcttgcaggtgcaacgtctgttctccctaaggaggaagaagcaaaagatccagttgcattgaaaaaactgatcgcatcagaagagattacacattactacggtgtgcctagtttgtttagtgccattcttgatgtttcttctagtaaggatttgcaaaatttacgctgcgtcactttgggaggagagaaattaccggctcaaattgttaaaaaaatcaaagaaaaaaataaagaaattgaagtcaacaacgaatatgggcctactgaaaatagtgtagtaactactattatgcgcgatatacaggtagaacaagagattactattggtcgcccattatctaacgtagatgtatatattgtcaattgtaatcatcaattacaaccagtaggtgtagtaggggaattatgtattggtggacagggacttgcaagaggatatttgaataaaccagagcttacagcagataaatttgttgtaaatccattcgtacctggtgaacgtatgtacaaaaccggtgaccttgcaaaatggcgctcagatggaatgattgaatatgtggggcgtgttgatgaacaagtaaaagtaagaggatatcggattgagcttggtgaaattgaatcagctatcctagaatacgaaaaaattaaggaagcggtagttatggtttcggagcatactgcatctgaacagatgttatgtgcttatattgtaggggaagaagatgtactgactctggacttaagaagctatctagcaaaattactaccaagttatatgattccaaactattttatccaattggatagtattccgcttacaccaaacggtaaagtggatcgtaaagcattgcctgaacctcaaaccattggcttaatggcaagggagtatgttgcaccaaggaatgaaatcgaagcacagctcgtactcatttggcaagaggtattaggaatagaactgatcggtattaccgataatttctttgaattaggagggcattctttaaaggcaacgcttttagttgcaaaaatttacgagtacatgcaaatagagatgccattaaatgttgtgtttaaacattcaactattatgaaaatagcggaatatattacacatcaagaatcagaaaataatgtacatcagcctattttggtaaatgtagaagcagatagagaggcgctatctcttaacggcgagaagcaaagaaaaaatatagagctacctattctgctaaacgaagaaacagatcgaaacgtattcctgttcgcgcccattggtgcacaaggtgttttttataaaaagcttgctgaacaaatccctactgcatccttgtatggctttgacttcattgaagatgatgatcgaattcagcaatatattgaatcgatgattcaaactcagtcagacggacaatatgtgctaattggttattcttcaggagggaacctggcttttgaagtagcaaaagaaatggaaaggcaaggatatagtgtatctgatttggtcttgttcgatgtttactggaagggaaaagtcttcgagcaaacaaaagaagaagaagaagaaaacataaaaataataatggaagaattaagggaaaatccaggaatgttcaatatgacacgagaggattttgaactgtattttgcgaatgaatttgtgaaacaaagtttcacacggaaaatgcgcaaatacatgagtttttatacgcagttagttaattatggggaagtagaagctacaattcaccttatacaagcagaatttgaggaagaaaaaattgacgaaaacgaaaaagccgacgaagaagaaaaaacatatctagaggaaaaatggaatgaaaaagcatggaacaaagcagcaaaaagatttgtaaaatataacggatatggcgctcattctaacatgctaggaggtgatggtttagagagaaattcctctatccttaaacagatactacaagggacatttgtagtaaaa

SEQ ID NO: 90 - protein, 1342 aa, Artificial Sequence
  synthetic
LFETPTIQGLAKYIEETDTEQYMAIQPVSGQDYYPVSSAQKRMFIVNQFVGVGISYNMPSIMLIEGKLERTRLESAFKRLIERHESLRTSFEIINGKPVQKIHEEVDFNMSYQVASNEQVEKMIDEFIQPFDLSVAPLLRVELLKLEEDRHVLIFDMHHIISDGISSNILMKELGELYQGNALPELRIQYKDFAVWQNEWFQSEAFKKQEEYWVNVFADERPILDIPTDYPRPMQQSFDGAQLTFGTGKQLMDGLYRVATETGTTLYMVLLAAYNVLLSKYSGQEDIIVGTPIVGRSHTDLENIVGMFVNTLAMRNKPEGEKTFKAFVSEIKQNALAAFENQDYPFEELIEKLEIQRDLSRNPLFDTLFSLQNIGEESFELAELTCKPFDLVSKLEHAKFDLSLVAVVFEEEIAFGLQYCTKLYKEKTVEQLAQHFIQIVKAIVENPDVKLSDIDMLSEEEKKQIMLEFNDTKIQYTQNQTIQELFEEQVKKTPEHIAIVWEGQALIYHELNIKANQLARVLREKGVTPNHPVAIMTERSLEMIVGIFSILKAGGAYVPIDPAYPQERIQYLLEDSGAALLLTQSHVLNKLPVDIEWLDLTDEQNYVEDGTNLPFMNQSTDLAYIIYTSGTTGKPKGVMIEHQSIINCLQWRKEEYEFGPGDTALQVFSFAFDGFVASLFAPILAGATSVLPKEEEAKDPVALKKLIASEEITHYYGVPSLFSAILDVSSSKDLQNLRCVTLGGEKLPAQIVKKIKEKNKEIEVNNEYGPTENSVVTTIMRDIQVEQEITIGRPLSNVDVYIVNCNHQLQPVGVVGELCIGGQGLARGYLNKPELTADKFVVNPFVPGERMYKTGDLAKWRSDGMIEYVGRVDEQVKVRGYRIELGEIESAILEYEKIKEAVVMVSEHTASEQMLCAYIVGEEDVLTLDLRSYLAKLLPSYMIPNYFIQLDSIPLTPNGKVDRKALPEPQTIGLMAREYVAPRNEIEAQLVLIWQEVLGIELIGITDNFFELGGHSLKATLLVAKIYEYMQIEMPLNVVFKHSTIMKIAEYITHQESENNVHQPILVNVEADREALSLNGEKQRKNIELPILLNEETDRNVFLFAPIGAQGVFYKKLAEQIPTASLYGFDFIEDDDRIQQYIESMIQTQSDGQYVLIGYSSGGNLAFEVAKEMERQGYSVSDLVLFDVYWKGKVFEQTKEEEEENIKIIMEELRENPGMFNMTREDFELYFANEFVKQSFTRKMRKYMSFYTQLVNYGEVEATIHLIQAEFEEEKIDENEKADEEEKTYLEEKWNEKAWNKAAKRFVKYNGYGAHSNMLGGDGLERNSSILKQILQGTFVVK

I claim:

1. A molecular assembly line comprising:
   (a) a synthetic RNA scaffold that comprises at least two aptamers, wherein each aptamer comprises a polypeptide binding site; and
   (b) at least two nonribosomal peptide synthetase (NRPS) fusion proteins, each NRPS fusion protein comprising a NRPS module fused to a RNA-binding peptide that specifically binds to the polypeptide binding site of at least one aptamer within the synthetic RNA scaffold, wherein the synthetic RNA scaffold and the at least two NRPS fusion proteins form a complex.

2. The molecular assembly line of claim 1, wherein at least one NRPS module is selected from licA1, licA2, licB1, licB3, licC1, tycB, tycC, lgrA, lgrB, lgrC, lgrD, grsB, srfA1, srfA2, and srfA3.

3. The molecular assembly line of claim 1, wherein the synthetic RNA scaffold comprises tRNA analogs.

4. The molecular assembly line of claim 1, wherein at least one RNA-binding peptide comprises an RNA-binding domain from a protein selected from Lambda N, P22N, RevN7D, HTLV-1-Rex, and BIV-Tat.

5. The molecular assembly line of claim 4, wherein at least one RNA-binding peptide binds to an aptamer sequence within a tRNA analog.

6. A synthetic nucleic acid sequence encoding the molecular assembly line of claim 1.

7. A biological cell comprising the synthetic nucleic acid sequence of claim 6.

8. A method for assembling the molecular assembly line of claim 1, the method comprising:
   (a) providing the molecular assembly line to a cell-free expression system; and
   (b) incubating the cell-free expression system containing the molecular assembly line under conditions wherein the NRPS fusion proteins are able to bind to the synthetic RNA scaffold.

9. The method of claim 8, wherein at least one NRPS module is selected from licA1, licA2, licB1, licB3, licC1, tycB, tycC, lgrA, lgrB, lgrC, lgrD, grsB, srfA1, srfA2, and srfA3.

10. The method of claim 8, wherein the synthetic RNA scaffold comprises tRNA analogs.

11. The method of claim 8, wherein at least one RNA-binding peptide comprises an RNA-binding domain from a protein selected from Lambda N, P22N, RevN7D, HTLV-1-Rex, and BIV-Tat.

12. The method of claim 11, wherein at least one RNA-binding peptide binds to an aptamer sequence within a tRNA analog.

* * * * *